US011365223B2

(12) United States Patent
Poma et al.

(10) Patent No.: US 11,365,223 B2
(45) **Date of Patent: *Jun. 21, 2022**

(54) DE-IMMUNIZED, SHIGA TOXIN A SUBUNIT SCAFFOLDS AND CELL-TARGETING MOLECULES COMPRISING THE SAME

(71) Applicant: Molecular Templates, Inc., Austin, TX (US)

(72) Inventors: Eric Poma, New York, NY (US); Erin Willert, Round Rock, TX (US); Garrett Lee Robinson, Austin, TX (US); Sangeetha Rajagopalan, Round Rock, TX (US); Brigitte Brieschke, Austin, TX (US)

(73) Assignee: Molecular Templates, Inc., Austin, TX (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/233,911

(22) Filed: Apr. 19, 2021

(65) Prior Publication Data

US 2021/0253649 A1 Aug. 19, 2021

Related U.S. Application Data

(63) Continuation of application No. 15/577,827, filed as application No. PCT/US2016/034778 on May 27, 2016, now abandoned.

(60) Provisional application No. 62/168,758, filed on May 30, 2015, provisional application No. 62/168,759, filed on May 30, 2015, provisional application No. 62/168,760, filed on May 30, 2015, provisional application No. 62/168,761, filed on May 30, 2015, provisional application No. 62/168,762, filed on May 30, 2015, provisional application No. 62/168,763, filed on May 30, 2015.

(51) Int. Cl.
*C07K 14/25* (2006.01)
*C07K 19/00* (2006.01)

(52) U.S. Cl.
CPC .............. *C07K 14/25* (2013.01); *C07K 19/00* (2013.01); *C07K 2319/02* (2013.01); *C07K 2319/33* (2013.01); *C07K 2319/55* (2013.01)

(58) Field of Classification Search
None
See application file for complete search history.

(56) References Cited

U.S. PATENT DOCUMENTS

| | | | |
|---|---|---|---|
| 5,080,898 | A | 1/1992 | Murphy |
| 5,135,736 | A | 8/1992 | Anderson et al. |
| 5,552,144 | A | 9/1996 | Samuel et al. |
| 5,635,384 | A | 6/1997 | Walsh et al. |
| 5,668,255 | A | 9/1997 | Murphy |
| 5,858,682 | A | 1/1999 | Gruenwald et al. |
| 6,022,950 | A | 2/2000 | Murphy |
| 6,080,400 | A | 6/2000 | Williams et al. |
| 6,492,498 | B1 | 12/2002 | Vallera et al. |
| 6,652,857 | B2 | 11/2003 | Williams et al. |
| 6,770,456 | B1 | 8/2004 | Coulie et al. |
| 7,144,991 | B2 | 12/2006 | Goshom et al. |
| 7,267,973 | B2 | 9/2007 | Backer et al. |
| 7,527,787 | B2 | 5/2009 | Chang et al. |
| 7,700,557 | B2 | 4/2010 | Backer et al. |
| 7,713,915 | B1 | 5/2010 | Gariepy et al. |
| 7,799,900 | B2 | 9/2010 | Adams |
| 7,834,258 | B2 | 11/2010 | Choe et al. |
| 7,887,801 | B2 | 2/2011 | Wels et al. |
| 8,048,985 | B2 | 11/2011 | Harrison et al. |
| 8,147,832 | B2 | 4/2012 | Carr et al. |
| 8,337,844 | B2 | 12/2012 | Carr et al. |
| 8,470,314 | B2 | 6/2013 | Davis et al. |
| 8,530,637 | B2 | 9/2013 | Wels et al. |
| 8,865,866 | B2 | 10/2014 | Harrison et al. |
| 8,895,006 | B2 | 11/2014 | Turner et al. |
| 8,969,529 | B2 | 3/2015 | O'Brien et al. |
| 9,175,059 | B2 | 11/2015 | Pieczykolan et al. |
| 9,364,557 | B2 | 6/2016 | Neville, Jr. et al. |
| 10,421,958 | B2 | 9/2019 | Poma et al. |
| 10,815,469 | B2 | 10/2020 | Poma et al. |
| 11,136,395 | B2 | 10/2021 | Poma et al. |
| 2002/0012658 | A1 | 1/2002 | Williams et al. |
| 2002/0168370 | A1 | 11/2002 | McDonald et al. |
| 2003/0166196 | A1 | 9/2003 | Better et al. |

(Continued)

FOREIGN PATENT DOCUMENTS

| | | | |
|---|---|---|---|
| AU | 750367 B2 | | 7/2002 |
| CN | 1272882 A | | 11/2000 |
| CN | 105713087 | | 6/2016 |
| EP | 1 654 287 A2 | | 8/2010 |
| EP | 2 778 173 A1 | | 9/2014 |

(Continued)

OTHER PUBLICATIONS https://www.genome.gov/genetics-glossary/antisense retrieved Jul. 17, 2021.*

(Continued)

*Primary Examiner* — Oluwatosin A Ogunbiyi
(74) *Attorney, Agent, or Firm* — Cooley LLP

(57) ABSTRACT

The present invention relates to Shiga toxin A Subunit derived polypeptides and cell-targeting molecules comprising amino acid substitutions which equip the polypeptides with 1) de-immunization; 2) reduced, protease-cleavage sensitivity; and/or 3) a heterologous epitope cargo(s) while retaining Shiga toxin function(s), such as, e.g., potent cytotoxicity. Certain polypeptides of the invention exhibit reduced immunogenic potential in mammals and/or are capable of delivering an epitope to an MHC class molecule of a cell in which the polypeptide is present. Certain molecules comprising a polypeptide of the invention are well-tolerated by mammals while retaining one or more of the features mentioned above. The Shiga toxin polypeptides of the invention have uses as components of cell-targeting molecules for selectively killing specific cells; for selectively delivering cargos to specific cells, and as therapeutic and/or diagnostic molecules for treating and diagnosing a variety of conditions, including cancers, immune disorders, and microbial infections.

14 Claims, 18 Drawing Sheets

Specification includes a Sequence Listing.

(56) References Cited

U.S. PATENT DOCUMENTS

| | | | |
|---|---|---|---|
| 2004/0141982 | A1 | 7/2004 | Lust et al. |
| 2004/0166565 | A1 | 8/2004 | Backer et al. |
| 2005/0054835 | A1 | 3/2005 | Better et al. |
| 2005/0069545 | A1 | 3/2005 | Carr et al. |
| 2009/0023649 | A1 | 1/2009 | Backer et al. |
| 2009/0092578 | A1 | 4/2009 | Su et al. |
| 2009/0156417 | A1 | 6/2009 | Gariepy et al. |
| 2009/0156502 | A1 | 6/2009 | Harrison et al. |
| 2010/0093563 | A1 | 4/2010 | Williamson et al. |
| 2010/0285004 | A1 | 11/2010 | Tesar et al. |
| 2011/0189209 | A1 | 8/2011 | Neville, Jr. et al. |
| 2012/0039908 | A1 | 2/2012 | Combs et al. |
| 2012/0149650 | A1 | 6/2012 | Harrison et al. |
| 2012/0251542 | A1 | 10/2012 | Tumer et al. |
| 2012/0258104 | A1 | 10/2012 | Echeverri |
| 2013/0071325 | A1 | 3/2013 | Sahin et al. |
| 2013/0189271 | A1 | 7/2013 | De Goeij et al. |
| 2013/0196928 | A1 | 8/2013 | Gariepy et al. |
| 2014/0030273 | A1 | 1/2014 | Verploegen et al. |
| 2015/0044210 | A1 | 2/2015 | Mechaly et al. |
| 2015/0259428 | A1 | 9/2015 | Poma et al. |
| 2016/0017047 | A1 | 1/2016 | Poma et al. |
| 2016/0017784 | A1 | 1/2016 | Kumar |
| 2016/0068577 | A1 | 1/2016 | Poma et al. |
| 2016/0130362 | A1 | 5/2016 | de Weers |
| 2016/0177284 | A1 | 6/2016 | Poma et al. |
| 2016/0340394 | A1 | 11/2016 | Poma et al. |
| 2016/0347798 | A1 | 12/2016 | Poma et al. |
| 2016/0355803 | A1 | 12/2016 | Poma et al. |
| 2016/0376328 | A1 | 12/2016 | Poma et al. |
| 2017/0002016 | A1 | 1/2017 | Shishido et al. |
| 2017/0002046 | A1 | 1/2017 | Poma et al. |
| 2017/0101636 | A1 | 4/2017 | Poma et al. |
| 2017/0143814 | A1 | 5/2017 | Poma et al. |
| 2017/0275382 | A1 | 9/2017 | Poma et al. |
| 2018/0057544 | A1 | 3/2018 | Poma et al. |
| 2018/0243432 | A1 | 8/2018 | Poma et al. |
| 2018/0258143 | A1 | 9/2018 | Poma et al. |
| 2018/0258144 | A1 | 9/2018 | Poma et al. |
| 2018/0291359 | A1 | 10/2018 | Poma et al. |
| 2019/0083644 | A1 | 3/2019 | Yoo et al. |
| 2019/0100597 | A1 | 4/2019 | Keyt et al. |
| 2019/0153044 | A1 | 5/2019 | Poma et al. |
| 2019/0153471 | A1 | 5/2019 | Paul et al. |
| 2019/0249145 | A1 | 8/2019 | Jang et al. |
| 2019/0382755 | A1 | 12/2019 | Poma et al. |
| 2020/0002387 | A1 | 1/2020 | Poma et al. |
| 2020/0024312 | A1 | 1/2020 | Poma et al. |
| 2021/0008208 | A1 | 1/2021 | Poma et al. |
| 2021/0017512 | A1 | 1/2021 | Poma et al. |
| 2021/0253648 | A1 | 8/2021 | Poma et al. |
| 2021/0268085 | A1 | 9/2021 | Poma et al. |

FOREIGN PATENT DOCUMENTS

| | | | |
|---|---|---|---|
| EP | 3 265 575 | A2 | 1/2018 |
| EP | 3 448 874 | A1 | 3/2019 |
| GB | 2 519 786 | A | 5/2015 |
| JP | 1993-502880 | A | 5/1993 |
| JP | 2001-500730 | A | 1/2001 |
| JP | 2002-521019 | A | 7/2002 |
| JP | 2002-544173 | A | 12/2002 |
| JP | 2003-531588 | A | 10/2003 |
| JP | 2004-536778 | A | 12/2004 |
| JP | 2006-502699 | A | 1/2006 |
| JP | 2006-513691 | A | 4/2006 |
| JP | 2007-536905 | A | 12/2007 |
| JP | 2008-533977 | A | 8/2008 |
| JP | 2009-502936 | A | 1/2009 |
| JP | 2009-530468 | A | 8/2009 |
| JP | 2011-050388 | A | 3/2011 |
| JP | 2011-507389 | A | 3/2011 |
| JP | 2012-044997 | A | 3/2012 |
| JP | 2012-070737 | A | 4/2012 |
| JP | 2012-515551 | A | 7/2012 |
| JP | 2014-515921 | A | 7/2014 |
| KR | 2011-0033233 | A | 3/2011 |
| KR | 2011-0119725 | A | 11/2011 |
| WO | WO 91/009871 | A1 | 7/1991 |
| WO | WO 94/26910 | A1 | 11/1994 |
| WO | WO 96/30043 | A1 | 10/1996 |
| WO | WO 96/040200 | A1 | 12/1996 |
| WO | WO 98/11229 | A3 | 3/1998 |
| WO | WO 99/40185 | A1 | 8/1999 |
| WO | WO 00/04926 | A2 | 2/2000 |
| WO | WO 00/67795 | A1 | 11/2000 |
| WO | WO 01/70945 | A1 | 9/2001 |
| WO | WO 01/77342 | A1 | 10/2001 |
| WO | WO 02/40506 | A2 | 5/2002 |
| WO | WO 03/066854 | A1 | 8/2003 |
| WO | WO 03/072746 | A2 | 9/2003 |
| WO | WO 03/074567 | A2 | 9/2003 |
| WO | WO 2004/056312 | A2 | 7/2004 |
| WO | WO 2004/058158 | A2 | 7/2004 |
| WO | WO 2005/000902 | A1 | 1/2005 |
| WO | WO 2005/016969 | A2 | 2/2005 |
| WO | WO 2005/017148 | A1 | 2/2005 |
| WO | WO 2005/052006 | A2 | 6/2005 |
| WO | WO 2005/052129 | A2 | 6/2005 |
| WO | WO 2005/092917 | A1 | 10/2005 |
| WO | WO 2006/099875 | A1 | 9/2006 |
| WO | WO 2007/005874 | A2 | 1/2007 |
| WO | WO 2007/014238 | A2 | 2/2007 |
| WO | WO 2007/033497 | A1 | 3/2007 |
| WO | WO 2007/071061 | A1 | 6/2007 |
| WO | WO 2007/098201 | A2 | 8/2007 |
| WO | WO 2007/107779 | A1 | 9/2007 |
| WO | WO 2008/080218 | A1 | 7/2008 |
| WO | WO 2009/014835 | A2 | 1/2009 |
| WO | WO 2009/017823 | A2 | 2/2009 |
| WO | WO 2009/032954 | A1 | 3/2009 |
| WO | WO 2009/064815 | A1 | 5/2009 |
| WO | WO 2009/088403 | A2 | 7/2009 |
| WO | WO 2009/110944 | A1 | 9/2009 |
| WO | WO 2010/011697 | A1 | 1/2010 |
| WO | WO 2010/085539 | A1 | 7/2010 |
| WO | WO 2011/009624 | A1 | 1/2011 |
| WO | WO 2012/022985 | A1 | 2/2012 |
| WO | WO 2012/093158 | A1 | 7/2012 |
| WO | WO 2012/101235 | A1 | 8/2012 |
| WO | WO 2012/104344 | A1 | 8/2012 |
| WO | WO 2012/154530 | A1 | 11/2012 |
| WO | WO 2013/080147 | A2 | 6/2013 |
| WO | WO 2014/086952 | A1 | 6/2014 |
| WO | WO 2014/164680 | A1 | 10/2014 |
| WO | WO 2014/164693 | A2 | 10/2014 |
| WO | WO 2015/063187 | A1 | 5/2015 |
| WO | WO 2015/113005 | A1 | 7/2015 |
| WO | WO 2015/113007 | A1 | 7/2015 |
| WO | WO 2015/120058 | A2 | 8/2015 |
| WO | WO 2015/138435 | A1 | 9/2015 |
| WO | WO 2015/138452 | A1 | 9/2015 |
| WO | WO 2015/191764 | A1 | 12/2015 |
| WO | WO 2015/191883 | A1 | 12/2015 |
| WO | WO 2015/193411 | A1 | 12/2015 |
| WO | WO 2016/126950 | A1 | 8/2016 |
| WO | WO 2016/196344 | A1 | 12/2016 |
| WO | WO 2017/019623 | A2 | 2/2017 |
| WO | WO 2018/080812 | A1 | 5/2018 |
| WO | WO 2018/106895 | A1 | 6/2018 |
| WO | WO 2018/140427 | A1 | 8/2018 |
| WO | WO 2018/159615 | A1 | 9/2018 |
| WO | WO 2018/162749 | A1 | 9/2018 |
| WO | WO 2019/059400 | A1 | 3/2019 |
| WO | WO 2020/081493 | A1 | 4/2020 |
| WO | WO 2020/154475 | A1 | 7/2020 |

OTHER PUBLICATIONS

Amino Acids; https://www.promega.com/-/media/files/resources/technical-references/amino-acid-abbreviations-and-molecular-weights.pdf; retrieved on Feb. 26, 2018, 1 page.

(56) References Cited

OTHER PUBLICATIONS

UniProtKB/Swiss-Prot P09385 (STXA_BP933), Shiga-like toxin 2 subunit A, retrieved from https://www.ncbi.nlm.nih.gov/protein/P09385.2 on Jan. 10, 2018, 7 pages.
Aatsinki, J. T. et al., "An alternative use of basic pGEX vectors for producing both N- and C-terminal fusion proteins for production and affinity purification of antibodies," Protein Expression and Purification, 40(2):287-291 (2005).
Ackerman, R et al., "SLT-VEGF Reduces Lung Metastases, Decreases Tumor Recurrence, and Improves Survival in an Orthotropic Melanoma Model," Toxins (Basel), 2(9):224-257 (2010).
Adotevi, O. et al., "B Subunit of Shiga Toxin-Based Vaccines Synergize with a-Galactosylceramide to Break Tolerance against Self Antigen and Elicit Antiviral Immunity," The Journal of Immunology, 179(5):3371-3379 (2007).
Al-Jaufy, A. Y. et al., "Cytotoxicity of a Shiga toxin A Subunit-CD4 Fusion Protein to Human Immunodeficiency Virus-Infected Cells," Infection and Immunity, 62(3):956-960 (1994).
Al-Jaufy, A. Y. et al., "Purification and Characterization of a Shiga-Toxin A Subunit-CD4 Fusion Protein Cytotoxic to Human Immunodeficiency Virus-Infected Cells," Infection and Immunity, 63(8):3073-3078 (1995).
Antignani, A. & Fitzgerald, D., "Immunotoxins: The Role of the Toxin," Toxins, 5(8):1486-1502 (2013).
Apostolpoulos, V. et al., "MUC1 peptide epitopes associated with five different H-2 class I molecules," European Journal of Immunology, 27(10):2579-2587 (1997).
Backer, M. V. et al., "Shiga-like toxin-VEGF fusion proteins are selectively cytotoxic to endothelial cells overexpressing VEGFR-2," Journal of Controlled Release, 74(1-3):349-355 (2001).
Backer, M. V. & Backer, J. M., "Targeting Endothelial Cells Overexpressing VEGFR-2: Selective Toxicity of Shiga-like Toxin-VEGF Fusion Proteins," Bioconjugate Chemistry, 12(6):1066-1073 (2001).
Baker, M. P. et al., "Immunogenicity of Protein Therapeutics: The Key Causes, Consequences and Challenges," Self/Nonself, 1(4):314-322 (2010).
Ballard, J. D. et al., "Anthrax Toxin-Mediated Delivery In Vivo and In Vitro of a Cytotoxic T-Lymphocyte Epitope from Ovalbumin," Infection and Immunity, 66(2):615-619 (1998).
Ballard, J. D. et al., "Anthrax Toxin as a Molecular Tool for Stimulation of Cytotoxic T Lymphocytes: Disulfide-Linked Epitopes, Multiple Injections, and Role of CD4+ Cells," Infection and Immunity, 66(10):4696-4699 (1998).
Barnd, D. L. et al., "Specific, Major Histocompatibility Complex-Unrestricted Recognition of Tumor-Associated Mucins by Human Cytotoxic T cells," Proceedings of the National Academy of Sciences U.S.A., 86(18):7159-7163 (1989).
Barratt-Boyes, S. M. et al., "Immunization of Chimpanzees with Tumor Antigen MUC1 Mucin Tandem Repeat Peptide Elicits Both Helper and Cytotoxic T-cell Responses," Clinical Cancer Research, 5(7):1918-1924 (1999).
Beers, S. A. et al., "Type II (tositumomab) anti-CD20 monoclonal antibody outperforms type I (rituximab-like) reagents in B-cell depletion regardless of complement activation," Blood, 112:4170-4177 (2008).
Beers, S. A. et al., "CD20 as A Target for Therapeutic type I and II Monoclonal Antibodies," Seminars in Hematology, 47(2):107-114 (2010).
Beers, S. A. et al., "Antigenic modulation limits the efficacy of anti-CD20 antibodies: implications for antibody selection," Blood, 1115(25):5191-5201 (2010).
Bera, T. K. et al., "A Bivalent Disulfide-stabilized Fv with Improved Antigen Binding to erbB2," Journal of Molecular Biology, 281(3):475-483 (1998).
Bera, T. K. et al., "Pharmacokinetics and Antitumor Activity of a Bivalent Disulfide-stabilized Fv Immunotoxin with Improved Antigen Binding to erbB2," Cancer Research, 59(16):4018-4022 (1999).
Beum, P. V. et al., "The Shaving Reaction: Rituximab/CD20 Complexes Are Removed from Mantle Cell Lymphoma and Chronic Lymphocytic Leukemia Cells by THP-1 Monocytes," The Journal of Immunology, 176(4):2600-2609 (2006).
Beum, P. V. et al., "Loss of CD20 and Bound CD20 Antibody from Opsonized B Cells Occurs More Rapidly Because of Trogocytosis Mediated by Fc Receptor-Expressing Effector Cells than Direct Internalization by the B Cells," The Journal of Immunology, 187(6):3438-3447 (2011).
Bevan et al. "Real-time 96-well antibody internalization assays using IncuCyte FabFlour Red Antibody Labeling Reagent, Application Note, Sartorious", Essen BioScience (2017).
Bibby, M. C., "Orthotopic models of cancer for preclinical drug evaluation: advantages and disadvantages," European Journal of Cancer, 40(6):852-857 (2004).
Boes, A. et al., "Affinity Purification of a Framework 1 Engineered Mouse/Human Chimeric IgA2 Antibody From Tobacco," Biotechnology Bioengineering, 108(12):2804-2814 (2011).
Böldicke, T., "Blocking translocation of cell surface molecules from the ER to the cell surface by intracellular antibodies targeted to the ER," J. Cell. Mol., 11(1):54-70 (2007).
Bolognesi, A. et al., "A comparison of anti-lymphocyte immunotoxins containing different ribosome-inactivating proteins and antibodies," Clinical & Experimental Immunology, 89(3):341-346 (1992).
Bonifaz, L. et al., "Efficient targeting of protein antigen to the dendritic cell receptor DEC-205 in the steady state leads to antigen presentation on major histocompatibility complex class I products and peripheral CD8+ T cell tolerance," Journal of Experimental Medicine, 196(12):1627-1638 (2002).
Boross, P. et al., "Both activating and inhibitory Fc gamma receptors mediate rituximab-induced trogocytosis of CD20 in mice," Immunology Letters, 143(1):44-52 (2012).
Boross, P. et al., "Mechanisms of action of CD20 antibodies," American Journal of Cancer Research, 2(6):676-690 (2012).
Braslawsky, G. R. et al., "Adriamycin(hydrazone)-antibody conjugates require internalization and intracellular acid hydrolysis for antitumor activity," Cancer Immunology, Immunotherapy, 33:367-374 (1991).
Bray, M. R. et al., "Probing the surface of eukaryotic cells using combinatorial toxin libraries," Current Biology, 11(9):697-701 (2001).
Brieschke, B. et al., "Targeted Engineered Toxin Bodies provide a novel mechanism of action against HER2 positive cancers," Cancer Research, 78 (13 Suppl), (Jul. 2018), Abstract 5769.
Brieschke, B. et al., "Targeted Engineered Toxin Bodies provide a novel mechanism of action against HER2 positive cancers," Proceedings: American Association for Cancer Research (AACR) Annual Meeting 2018, (Apr. 18, 2018).
Brieschke, B. et al., "Identification and Functional Profiling of PD-L1 Targeted Engineered Toxin Bodies for Antigen Seeding Technology (AST) and Redirection of T cell Response to Tumors," 33rd Annual Meeting of the Society for Immunotherapy of Cancer (SITC), Washington, D.C., Poster # 11078, (Nov. 7-11, 2018).
Brieschke, B. et al., "Identification and functional profiling of PD-L1 targeted engineered toxin bodies for antigen seeding technology and redirection of T cell response to tumors," Journal of ImmunoTherapy of Cancer, 6(Suppl 1): 114, (Nov. 6, 2018), Abstract P9.
Brieschke, B. et al., "Identification and functional profiling of PD-L1 targeted engineered toxin bodies for antigen seeding technology and redirection of T cell response to tumors," Journal for Immunotherapy of Cancer, 6(S1): p. 5 (2018).
Brieschke, B. et al., "Antigen Seeding Technology by engineered Toxin bodies Provides a Targeted Immuno-Oncology Approach for Treatment of Cancers," Proceedings: American Association for Cancer Research (AACR) Annual Meeting 2018, Poster 2777, Abstract #4912 (Apr. 14-18, 2018).
Brigotti, M. et al., "Damage to Nuclear DNA Induced by Shiga Toxin 1 and Ricin in Human Endothelial Cells," The FASEB Journal, 16(3):365-372 (2002).
Brigotti, M. et al., "Change in Conformation with Reduction of a-Helix Content Causes Loss of Neutrophil Binding Activity in Fully Cytotoxic Shiga toxin 1," The Journal of Biological Chemistry, 286(40):34514-34521 (2011).

(56) References Cited

OTHER PUBLICATIONS

Bujny, M. V. et al., "The retromer component sorting nexin-1 is required for efficient retrograde transport of Shiga toxin from early endosome to the trans Golgi network," Journal of Cell Science, 120(Pt 12):2010-2021 (2007).
Burgess, B. J. et al., "Proteolytic cleavage at arginine residues within the hydrophilic disulphide loop of the *Escherichia coli* Shiga-like toxin I A subunit is not essential for cytotoxicity," Molecular Microbiology, 10(1):171-179 (1993).
Cao, C. et al., "Construction of mutant genes for a non-toxic verotoxin 2 variant (VT2vp1) of *Escherichia coli* and characterization of purified mutant toxins," Microbiology and Immunology, 38(6):441-447 (1994).
Cao, Y. et al., "Design optimization and characterization of Her2/neu-targeted immunotoxins: comparative in vitro and in vivo efficacy studies," Oncogene, 33(4):1-11 (2013).
Cao, Y. et al., "Construction and characterization of novel, recombinant immunotoxins targeting the Her2/neu oncogene product: in vitro and in vivo studies," Cancer Research, 69(23): 8987-8995 (2009).
Carbonetti, N. H. et al., "Intracellular Delivery of a Cytolytic T-Lymphocyte Epitope Peptide by Pertussis Toxin to Major Histocompatibility Complex Class I without Involvement of the Cytosolic Class I Antigen Processing Pathway," Infection and Immunity, 67(2):602-607 (1999).
Carbonetti, N. H. et al., "Stimulation of HIV gp120-specific cytolytic T lymphocyte responses in vitro and in vivo using a detoxified pertussis toxin vector," AIDS Research and Human Retroviruses, 17(9): 819-827 (2001).
Carbonetti, N. H., "Pertussis toxin and adenylate cyclase toxin: key virulence factors of Bordetella pertussis and cell biology tools," Future Microbiology, 5:455-469 (2010).
Casalini, P. et al., "Use of combination of Monoclonal Antibodies Directed Against three distinct epitopes of a Tumor-Associated Antigen: Analysis of Cell-Binding and Internalization," International Journal of Cancer, 48:2 284-290 (1991).
Casset, F. et al., "A peptide mimetic of an anti-CD4 monoclonal antibody by rational design," Biochemical and Biophysical Research Communications, 307(1):198-205 (2003).
Chatterjee, S. et al., "Noninvasive Imaging of Immune Checkpoint Ligand PD-L1 in Tumors and Metastases for Guiding Immunotherapy," Molecular Imaging, 16:1-5 (2017).
Cheung, M. C. et al., "An evolved ribo-inactivating protein targets and kills human melanoma cells in vitro and in vivo," Molecular Cancer, 9(28):1-14 (2010).
Cheung, M. C. et al., "A Ribosome-inactivating Protein Toxin as a Template for Cancer Drug Discovery", thesis, University of Toronto, (2012), retrieved from http://hdl.handle.net/1807/33952, 202 pages.
Cizeau, J. P. A. et al., "DeBouganin: A de-immunized toxin payload and its applications in oncology," 8th Fabisch-Symposium, 3rd Targeted Tumor Therapies, Berlin 2012, Mar. 21, 2012.
Cizeau, J. et al., "Fusogenics: A Recombinant Immunotoxin-Based Screening Platform to Select Internalizing Tumor-Specific Antibody Fragments," Journal of Biomolecular Screening 16(1):90-100 (2011).
Cleton-Jansen, A. et al., "A Single Amino Acid Substitution Changes the Substrate Specificity of Quinoprotein Glucose Dehydrogenase in Gluconobacteroxydans," Molecular and General Genetics, 229(2):206-212 (1991).
Cragg, M. S. et al., "Apparent modulation of CD20 by rituximab: an alternative explanation," Blood, 103(10):3889-3990 (2004).
Cuesta, A. M. et al., "Mutivalent antibodies: when design surpasses evolution," Trends in Biotechnology, 28(7):355-362 (2010).
Dadaglio, G, et al., "Induction of a Polarized Th1 Response by Insertion of Multiple Copies of a Viral T-Cell Epitope into Adenylate Cyclase of Bordetella pertussis," Infection and Immunity, 68(7):3867-3872 (2000).
Dadaglio, G, et al., "Recombinant adenylate cyclase toxin of Bordetella pertussis induces cytotoxic T lymphocyte responses against HLA*0201-restricted melanoma epitopes," International Immunology, 15(12):1423-1430 (2003).
De Pascalis, R. et al., "Grafting of "abbreviated" complementarity-determining regions containing specificity-determining residues essential for ligand contact to engineer a less immunogenic humanized monoclonal antibody," The Journal of Immunology, 169(6):3076-3084 (2002).
Dekker et al., "Engineered Toxin Bodies delivering immunogenic MHC class I peptides to tumor cells summon polyfunctional and relevant CTL responses against cancers," Presented at: Immunology 2019™, Annual Meeting of the American Association of Immunologists, May 10, 2019, The American Association of Immunologists, Inc., San Diego, Abstract 1791.
Dekker, J. D. et al., Abstract 1791, "Engineered toxin bodies delivering immunogenic MHC class I peptides to tumor cells summon polyfunctional and relevant CTL responses against cancers," Molecular Templates, AAI 2019, Poster, 2 pages.
Deresiewicz, R. L. et al., "Mutations Affecting the Activity of the Shiga-like Toxin I A-Chain," Biochemistry, 31(12):3272-3280 (1992).
Deresiewicz, R. L. et al., "The role of tyrosine-114 in the enzymatic activity of the Shiga-like toxin I A-chain," Mol. Gen. Genet., 241:467-473 (1993).
Déret, S. et al., "SUBIM: a program for analysing the Kabat database and determining the variability subgroup of a new immunoglobulin sequence," Cabios, 11(4):435-439 (1995).
Dermer, G. B., "Another Anniversary for the War on Cancer," Bio/Technology 12:320 (1994).
Di, R. et al., "Identification of amino acids critical for the cytotoxicity of Shiga toxin 1 and 2 in *Saccharomyces cerevisiae*," Toxicon, 57(4):525-539 (2011).
Doling, A. M. et al., "Cytotoxic T-Lymphocyte Epitopes Fused to Anthrax toxin Induce protective Antiviral Immunity," Infection and Immunity, 67(7):3290-3296 (1999).
Donnelly, J. J. et al., "Targeted delivery of peptide epitopes to class I major histocompatibility molecules by a modified Pseudomonas exotoxin," Proceedings of the National Academy of Sciences U.S. A., 90:3530-3534 (1993).
Engedal, N. et al., "Shiga toxin and its use in targeted cancer therapy and imaging," Microbiology Biotechnology, 4(1):32-46 (2011).
Eriksson, K. et al., "Coupling of antigen to cholera toxin for dendritic cell vaccination promotes the induction of MHC class I-restricted cytotoxic T cells and the rejection of a cognate antigen-expressing model tumor," European Journal of Immunology, 34(5):1272-1281 (2004).
Ewers, H. & Helenius, A., "Lipid-Mediated Endocytosis," Cold Spring Harbor Perspectives in Biology, 3(8):1-14 (2011).
Fanale, M. A. et al., "Phase I/Ib study of the novel CD20-targeted immunotoxin MT-3724 in relapsed/refractory non-Hodgkin's B-cell lymphoma," Proceedings of the 107th Annual Meeting of the American Association for Cancer Research (AACR), Abstract # CT049, (Apr. 16-20, 2016), 2 pages.
Fanale, M. A. et al., "Phase I/Ib study of the novel CD20-targeted immunotoxin MT-3724 in relapsed/refractory non-Hodgkin's B-cell lymphoma," Cancer Research, 76(14 Suppl), (Jul. 2016), Abstract nr CT049.
Fayolle, C. et al., "Delivery of Multiple Epitopes by Recombinant Detoxified Adenylate Cyclase of Bordetella pertussis Induces Protective Antiviral Immunity," Journal of Virology, 75(16):7330-7338 (2001).
Fayolle, C, et al., "Therapy of Murine Tumors with Recombinant Bordetella pertussis Adenylate Cyclase Carrying a Cytotoxic T Cell Epitope," The Journal of Immunology, 162(7): 4157-4162 (1999).
Filpula, D., "Releasable PEGylation of Mesothelin Targeted Immunotoxin SSIP Achieves Single Dosage Complete Regression of a Human Carcinoma in Mice," Bioconjugate Chemistry, 18(3):773-784 (2007).
Freshney, R.I., "Culture of Animal Cells: A Manual of Basic Technique," Alan R. Liss, Inc., 1983, New York, pp. 3-4.
Gannon, V. P. et al., "Molecular cloning and nucleotide sequence of another variant of the *Escherichia coli* Shiga-like toxin II family," Journal of General Microbiology, 136(6):1125-1135 (1990).
Garred, O. et al., "Role of processing and intracellular transport for optimal toxicity of Shiga toxin and toxin mutants," Experimental Cell Research, 218(1):39-49 (1995).

(56) References Cited

OTHER PUBLICATIONS

Garred, O. et al., "Furin-induced cleavage and activation of Shiga toxin," Journal of Biological Chemistry, 270(18):10817-10821 (1995).
Gavrilov, B. K. et al., "Effects of Glycosylation on Antigenicity and Immunogenicity of Classical Swine Fever Virus Envelope Proteins," Virology, 420(2):135-145 (2011).
Gendler, S. et al., "A Highly Immunogenic Region of a Human Polymorphic Epithelial Mucin Expressed by Carcinomas Is Made Up of Tandem Repeats," Journal of Biological Chemistry, 263(26):12820-12823 (1988).
Ghetie, M. A. et al., "Homodimers but not monomers of Rituxan (chimeric anti-CD20) induce apoptosis in human B-lymphoma cells and synergize with a chemotherapeutic agent and an immunotoxin," Blood, 97(5):1392-1398 (2001).
Giansanti, F. et al., "Strategies to Improve the Clinical Utility of Saporin-Based Targeted Toxins," Toxins, 10(82):1-32 (2018).
Glelis, S. et al., "Detection of Enriched T Cell Epitope Specificity in Full T Cell Receptor Sequence Repertoires," Frontiers in Immunology, vol. 10, Article 2820, pp. 1-13 (2019).
Gilliland, D. G. et al., "Antibody-directed cytotoxic agents: use of monoclonal antibody to direct the action of toxin A chains to colorectal carcinoma cells," Proceedings of the National Academy of Sciences of the United States of America, 77(8):4539-43 (1980).
Glennie, M. J. et al., "Mechanisms of killing by anti-CD20 monoclonal antibodies," Molecular Immunology, 44(16):3823-3837 (2007).
Gong, J. et al., "Selection and characterization of MUC1-specific CD8+T cells from MUC1 transgenic mice immunized with dendritic-carcinoma fusion cells," Immunology, 101(3):316-324 (2000).
Gordon, V. M. et al., "An enzymatic Mutant of Shiga-like Toxin II Variant is a vaccine Candidate for Edema Disease of Swine," Infection and Immunity, 60(2):485-490 (1992).
Goulet, A. C. et al., "Conjugation of Blocked Ricin to an Anti-CD19 Monoclonal Antibody Increases Antibody-Induced cell Calcium Mobilization and CD19 Internalization," Blood 90(6): 2364-2375 (1995).
Grant, K. et al., "Abstract 1380: Engineered toxin bodies with specific activity against EGFR and HER2 expressing cells," Proceedings of the 102nd Annual Meeting of the American Association for Cancer Research (AACR); Apr. 2-6, 2011; The Journal of Cancer Research, 71 (8 Suppl): Abstract #1380, (Apr. 2011).
Grotzke, J. E. et al., "The ongoing saga of the mechanism(s) of MHC class l-restricted cross-presentation," Current Opinion in Immunology, 46:89-96 (2017).
Guermonprez, P. et al., "Les Toxines Bacteriennes Recombinantes: De Nouveaux Vecteurs Pour La Vaccination?" M/S Medicine Sciences, Societe Des Periodiques Flammarion, 16(5):653-662 (2000).
Guermonprez, P. et al., "The Adenylate Cyclase Toxin of *Bordetella pertussis* Binds to Target Cells via the αMβ2 Integrin (CD11b/CD18)," Journal of Experimental Medicine, 193(9):1035-1044 (2001).
Güssow, D. & Seeman, G., "Humanization of Monoclonal Antibodies," Methods in Enzymology, 203:99-121 (1991).
Haddad, J. E. et al., "Minimum Domain of the Shiga Toxin A subunit Required for Enzymatic Activity," Journal of Bacteriology, 175(16):4970-4978 (1993).
Haicheur, N. et al., "The B Subunit of Shiga Toxin Fused to a Tumor Antigen Elicits CTL and Targets Dendritic Cells to Allow MHC Class I-Restricted Presentation of Peptides Derived from Exogenous Antigens," The Journal of Immunology, 165(6):3301-3308 (2000).
Haisma, H. J. et al., "Construction and Characterization of a Fusion Protein Single-Chain Anti-CD20 Antibody and Human beta-glucuronidase for Antibody-Directed Enzyme Prodrug Therapy," Blood, 92(1):184-190 (1998).
Hamlin, P. A. et al., "Safety and Efficacy of Anti-CD20 Immunotoxin MT-3724 in Relapsed/refractory B-cell Non-Hodgkin Lymphoma (NHL) in a Phase 1 study," American Society of Clinical Oncology Annual Meeting—Abstract 7580 (2018).
Harris, B., "Exploiting antibody-based technologies to manage environmental pollution," Trends in Biotechnology, Diagram figure taken from 17(7):290-296 (1999).
Harwerth, I. M. et al., Monoclonal Antibodies against the Extracellular Domain of the erbB-2 Receptor Function as Partial Ligand Agonists, Journal of Biol. Chem, 267(21):15160-15167 (1992).
Head, S. C. et al., "Preparation of VT1 and VT2 hybrid toxins from their purified dissociated subunits. Evidence for B subunit modulation of a subunit function," Journal of Biological Chemistry, 266(6):3617-3621 (1991).
Hegde, N. R. et al., "The use of databases, data mining and immunoinformatics in vaccinology: where are we?" Expert Opinion on Drug Discovery, 13(2):117-130 (2018).
Hexham, J. M. et al., "Influence of relative binding affinity on efficacy in a panel of anti-CD3 scFv immunotoxins," Molecular Immunology, 38(5):397-408 (2001).
Higgins, J. P. et al., "Engineered toxin bodies with specific cell kill activity against mesenchymal cells," Cancer Research, 71(8 Suppl) (Apr. 2011), Abstract #1751.
Hiraga, J. et al., "Down-regulation of CD20 expression in B-cell lymphoma cells after treatment with rituximab-containing combination chemotherapies: its prevalence and clinical significance," Blood, 113(20):4885-4893 (2009).
Holubova, J. et al., "Delivery of Large Heterologous Polypeptides across the Cytoplasmic Membrane of Antigen-Presenting Cells by the Bordetella RTX Hemolysin Moiety Lacking the Adenylyl Cyclase Domain," Infection and Immunity, 80(3):1181-1192 (2012).
Hooijberg et al., "Characterization of a series of isotype switch variants of new CD20 monoclonal antibody," Hybridoma, 15(1):23-31 (1996).
Hotz, B. et al., "Specific Targeting of Tumor Endothelial Cells by a Shiga-like Toxin-Vascular Endothelial Growth Factor Fusion Protein as a Novel Treatment Strategy for Pancreatic Cancer," Neoplasia, 12(10):797-806 (2010).
Hovde, C. J. et al., "Evidence that glutamic acid 167 is an active-site residue of Shiga-like toxin-I," Proceedings of the National Academy of Sciences of the United States of America, 85(8):2568-2572 (1988).
Huang, S. et al., "The CD20-specific engineered toxin antibody MT-3724 exhibits lethal effects against mantle cell lymphoma," Blood Cancer Journal, 8(3):33 (2018).
Huang, S. et al. "Abstract 3651: Preclinical examination of the effects of MT-3724, an engineered toxin body targeting CD20, in mantle cell lymphoma," AACR Annual Meeting Abstract (2017).
Huang, S. et al. "AACR 2017 | Poster 3651/24—Preclinical examination of the effects of a CD20-specific engineered toxin body, MT-3724, in Mantle Cell Lymphoma," AACR Annual Meeting, Poster 3651/24 (2017).
Iberg, A. et al., "Design and Characterization of Bispecific Engineered Toxin Bodies for Targeted Cancer Therapy," Proceedings: American Association for Cancer Research (AACR) Annual Meeting 2019, Poster #2984 (2019).
Ishikawa, S. et al., "Protection against Shiga Toxin I Challenge by Immunization of Mice with Purified Mutant Shiga Toxin 1," Infection and Immunity, 71(6):3235-3239 (2003).
Jackson, R. L. et al., "Mutational analysis of the Shiga Toxin and Shiga-like toxin II enzymatic subunits," Journal of Bacteriology, 172(6):3346-3350 (1990).
Jackson, M. E. et al., "The KDEL retrieval system is exploited by Pseudomonas exotoxin A, but not by Shiga-like toxin-1, during retrograde transport from the Golgi complex to the endoplasmic reticulum," Journal of Cell Science, 112(4):467-475 (1999).
Jain, R. K., "Barriers to Drug Delivery in Solid Tumors," Scientific American, 271(1):58-65 (1994).
Jilani, I. et al., "Anti-Idiotype versus anti-mouse Ig for detecting ritumixab," Blood, 103(10):3990 (2004).
Jilani, I. et al., "Transient down-modulation of CD20 by ritumixab in patients with chronic lymphocytic leukemia," Blood , 102(10):3514-3520 (2003).
Johannes, L. et al., "Retrograde Transport of KDEL-bearing B-fragment of Shiga Toxin," Journal of Biological Chemistry, 272(31):19554-19561 (1997).
Johannes, L. et al., "Shiga toxins-from cell biology to biomedical applications," Nature Reviews Microbiology, 8(2):105-116 (2010).
Johannes, L. & Decaudin, D., "Protein toxins: intracellular trafficking for targeted therapy," Gene Therapy, 12(18):1360-1368 (2005).

(56) References Cited

OTHER PUBLICATIONS

Johnson, N. et al., "Construction of an epitope vector utilizing the diphtheria toxin B-subunit," FEMS Microbiology Letters, 146(1):91-96 (1997).
Jones, D. T., "Critically Assessing the State-of-the-art in Protein Structure Prediction," The Pharmacogenomics Journal, 1(2):126-134 (2001).
Jubala, C. M. et al., "CD20 Expression in Normal Canine B cells and in Canine non-Hodgkin Lymphoma," Veterinary Pathology, 42(4):468-476 (2005).
Kar, P. et al., "Current methods for the prediction of T-cell epitopes," Peptide Science, 110:e24046 (2018), 17 pages; https://doi.org/10.1002/pep2.24046.
Karanikas, V. et al., "Antibody and T Cell Responses of Patients with Adenocarcinoma Immunized with Mannan-MUC1 Fusion Protein," Journal of Clinical Investigation, 100(11):2783-2792 (1997).
Karimova, G. et al., "Charge-dependent translocation of *Bordetella pertussis* adenylate cyclase toxin into eukaryotic cells: Implication for the in vivo delivery of CD8+ T cell epitopes into antigen-presenting cells," Proc. Natl. Acad. Sci. USA, 95:12532-12537 (1998).
Kelland, L. R., "'Of mice and men': values and liabilities of the athymic nude mouse model in anticancer drug development," European Journal of Cancer, 40(6):827-836 (2004).
Kim, G. B. et al., "A fold-back single chain diabody format enhances the bioactivity of an anti-monkey CD3 recombinant diphtheria toxin-based immunotoxin," Protein Engineering, 20(9):425-432 (2007).
Kotera, Y. et al., "Humoral Immunity against a Tandem Repeat Epitope of Human Mucin MUC-1 in Sera from Breast, Pancreatic, and Colon Cancer Patients," Cancer Research 54(11):2856-2860 (1994).
Kochenderfer, J. N. et al., "Construction and Pre-clinical Evaluation of an Anti-CD19 Chimeric Antigen Receptor," J Immunother., 32(7):689-702 (2009).
Kowanetz, M. et al., "Differential regulation of PD-L1 expression by immune and tumor cells in NSCLC and the response to treatment with atezolizumab (anti-PD-L1)," PNAS, 115(43):e10119-e10126 (2018).
Kurmanova, A. et al., "Structural requirements for furin-induced cleavage and activation of Shiga toxin," Biochemical and Biophysical Research Communications, 357(1):144-149 (2007).
Kyu, E., "Characterization of the A subunit mutants of Stx1 and Stx2 in *Saccharomyces cerevisiae*," Thesis, Rutgers, The State University of New Jersey, New Brunswick, retrieved from http://dx.doi.org/doi:10.7282/T34F1QWJ (2009), 57 pages.
Lakhrif, Z. et al., "A method to confer protein L binding ability to any antibody fragment," MAbs, 8(2):379-388 (2016).
Lambert, J. et al., "Purified Immunotoxins that are reactive with Human Lymphoid Cells: Monoclonal antibodies conjugated to the ribosome-inactivating proteins gelonin and the pokeweed antiviral proteins," Journal of Biological Chemistry, 260(22):12035-12041 (1985).
Lapointe, P. et al., "A Role for the Protease-sensitive Loop Region of Shiga-like Toxin 1 in the Retrotranslocation of its A Domain from the Endoplasmic Reticulum Lumen," Journal of Biological Chemistry, 280(24):23310-23318 (2005).
Laske, D. W. et al., "Intraventricular Immunotoxin Therapy for Leptomeningeal Neoplasia," Neurosurgery, 41(5):1039-1051 (1997).
Law, C. L. et al., "Efficient Elimination of B-Lineage Lymphomas by Anti-CD20-Auristatin Conjugates," Clinical Cancer Research, 10(23):7842-7851 (2004).
Lazar, E. et al., "Transforming Growth Factor alpha: Mutation of Aspartic Acid 47 and Leucine 48 Results in Different Biological Activities," Molecular and Cellular Biology, 8(3):247-1252 (1988).
Lea, N. et al., "Proteolytic cleavage of the A subunit is essential for maximal cytotoxicity of *Escherichia coli* O157:h7 Shiga-like toxin-1," Microbiology, 145(5):999-1004 (1999).
Lee, J. E. et al.,"Phylogenetic analysis of Shiga toxin 1 and Shiga toxin 2 genes associated with disease outbreaks," BMC Microbiology, 7(1):109 (2007), 12 pages; doi.org/10.1186/1471-2180-7-109.
Lee, H. T. et al., "Molecular mechanism of PD-1/PD-L1 blockade via anti-PD-L1 antibodies atezolizumab and durvalumab," Scientific Reports, 7(1):5532 (2017), 12 pages; doi: 10.1038/s41598-017-06002-8.
Lee, R. S. et al., "Major histocompatibility complex class I presentation of exogenous soluble tumor antigen fused to the B-fragment of Shiga toxin," European Journal of Immunology, 28: 2726-2737 (1998).
Lehmann, C. H. K. et al., "Direct Delivery of Antigens to Dendritic Cells via Antibodies Specific for Endocytic Receptors as a Promising Strategy for Future Therapies," Vaccines, 4(2):1-32 (2016).
Lev, A. et al., "Tumor-specific Ab-mediated targeting of MHC-peptide complexes induces regression of human tumor xenografts in vivo," *PNAS*, 101(24):9051-9056 (2004).
Li, H. et al., "The CD20 Calcium Channel is Localized to Microvilli and Constitutively Associated with Membrane Rafts: Antibody binding increases the affinity of the association through an epitope-dependent cross-linking-independent mechanism," Journal of Biological Chemistry, 279(19):19893-19901 (2004).
Li, B. et al., "Development of Novel Tetravalent Anti-CD20 Antibodies with Potent Antitumor Activity," Cancer Research, 68(7):2400-2408 (2008).
Li, M. et al., "Clinical targeting recombinant immunotoxins for cancer therapy," Onco Targets and Therapy, 10:3645-3665 (2017).
Li, Y. et al., "Correction to: Discovery and preclinical characterization of the antagonist anti-PD-L1 monoclonal antibody LY3300054," Journal for ImmunoTherapy of Cancer, vol. 6, No. 1, Jun. 2018, p. 1.
Lim, S. H. et al., "Fc gamma receptor IIb on target B cells promotes ritumixab internalization and reduces clinical efficacy," Blood, 118(9):2530-2540 (2011).
Ling, H. et al., "Structure of the Shiga-like Toxin I B-Pentameter complexed with an Analogue of Its Receptor Gb3," Biochemistry, 37(7):1777-1788 (1998).
Luqman, M. et al., "The antileukemia activity of a human antiCD40 antagonist antibody, HCD122, on human chronic lymphocytic leukemia cells," Blood, 112(3):711-720 (2008).
Lyu, M.-A. et al., "Cell-targeting fusion constructs containing recombinant gelonin," Methods in Enzymology, 502:167-214 (2012).
Maak, M. et al., "Tumor-Specific Targeting of Pancreatic Cancer with Shiga Toxin B-Subunit," Molecular Cancer Therapeutics, 10(10):1918-1928 (2011).
Mallard, F. et al., "Direct Pathway from Early/Recycling Endosomes to the Golgi Apparatus Revealed through the Study of Shiga Toxin B-fragment Transport," The Journal of Cell Biology, 143(4):973-990 (1998).
Mascarell, L. et al., "Induction of Neutralizing Antibodies and Th1-Polarized and CD4-Independent CD8+ T-Cell Responses following Delivery of Human Immunodeficiency Virus Type 1 Tat Protein by Recombinant Adenylate Cyclase of Bordetella pertussis," Journal of Virology, 79(15):9872-9884 (2005).
Mazor, Y. et al., "chFRP5-ZZ-PE38, a large IgG-toxin immunoconjugate outperforms the corresponding smaller FRP5(Fv)-ETA immunotoxin in eradicating ErbB2-expressing tumor xenografts," Cancer Letters, 257(1):124-135 (2007).
Mazor, R. et al., "Identification and elimination of an immunodominant T-cell epitope in recombinant immunotoxins based on Pseudomonas exotoxin A," Proceedings of the National Academy of Sciences U.S.A., 109(51):E3597-E3603 (2012).
McCluskey, A. J. et al., "The Cataytic Subunit of Shiga-like Toxin 1 Interacts with Ribosomal Stalk Proteins and is Inhibited by Their Conserved C-Terminal Domain," Journal of Molecular Biology, 378(2):375-386 (2008).
McCluskey et al., "Shiga-like Toxin 1: Molecular Mechanism of Toxicity and Discovery of Inhibitors", Thesis University of Toronto (2010); retrieved from the Internet: http://hdl.handle.net/1807/32046.

(56) References Cited

OTHER PUBLICATIONS

McCluskey et al., "Charged and hydrophobic Surfaces on the A chain of Shiga-like Toxin 1 recognize the C-terminal Domain of Ribosomal Stalk Proteins," PLoS One 7(2):e31191 (2012).
McKenzie, J, et al., "Passage through the Golgi is necessary for Shiga toxin B subunit to reach the endoplasmic reticulum," The FEBS Journal, 276(6):1581-1595, 2008.
Meeting Abstracts, "33rd Annual Meeting & Pre-Conference Programs of the Society for Immunotherapy of Cancer (SITC 2018)," Washington, D.C., USA, Nov. 7-11, 2018, Journal for ImmunoTherapy of Cancer, vol. 6, Supplement No. 1, Nov. 2018, pp. 1-205.
Meeting Abstracts, "34th Annual Meeting & Pre-Conference Programs of the Society for Immunotherapy of Cancer (SITC 2019): Part 2: National Harbor, MD, USA, Nov. 10, 2019," Journal for ImmunoTherapy of Cancer, vol. 7, Supplement No. 1, Nov. 2019, pp. 1-237, Abstract P804.
Michel, R. B. et al., "Intracellular Accumulation of the Anti-CD20 Antibody 1F5 in B-Lymphoma Cells," Clinical Cancer Research, 8(8):2701-2713 (2002).
Miller, R. B. et al., "Design, Construction, and In-Vitro analyses of Multivalent Antibodies," Journal of Immunology, 170(9):4854-4861 (2003).
Moise, L. et al., "T cell epitope engineering: an avian H7N9 influenza vaccine strategy for pandemic preparedness and response," Human Vaccines & Immunotherapeutics, 14(9):2203-2207 (2018).
Molecular Templates, Molecular Templates Provides Corporate Update and Outlines 2020 Milestones, Jan. 8, 2020, 2 pages.
Molecular Templates, Inc., R&D Day, Conference Call Transcript, Nov. 15, 2019, Fair Disclosure Wire, pp. 1-17; retrieved on Jan. 15, 2021 from https://dialog.proquest.com/professional/docview/2320577373.
Molecular Templates Corporate Presentation, Nov. 2019, 26 pages.
Newland, J. W. et al., "Cloning of Genes for Production of *Escherichia coli* Shiga-Like Toxin Type II," Infection and Immunity, 55(11):2675-2680 (1987).
Ninkovic, T. et al., "Identification of O-glycosylated decapeptides within the MUC1 repeat domain as potential MHC class I (A2) binding epitopes," Molecular Immunology 47(1):131-140 (2009).
Noakes, K. L. et al., "Exploiting retrograde transport of Shiga-like Toxin 1 for the delivery of exogenous antigens into the MHC class I presentation pathway," FEBS Letters, 453(1-2):95-99 (1999).
Ogishi, M. & Yotsuyanagi, H., "Quantitative Prediction of the Landscape of T Cell Epitope Immunogenicity in Sequence Space," Frontiers in Immunology, vol. 10, Article 827, pp. 1-20 (2019).
Ohmura, M. et al., "Characterization of non-toxic mutant toxins of Vero toxin I that were constructed by replacing amino acids in the A subunit," Microbial Pathogenesis, 15(3):169-176 (1993).
Olafsen, T. et al., "Recombinant Anti-CD20 Antibody fragments for Small-Animal PET Imaging of B-Cell Lymphomas," Journal of Nuclear Medicine, 50(9):1500-1508 (2009).
Olafsen, T. et al., "ImmunoPET imaging of B-cell lymphoma using anti-CD20 scFv dimers (diabodies)," Protein Engineering, Design & Selection, 23(4):243-249 (2010).
Oloomi, M. et al., "In vivo characterization of Fusion Protein Comprising of A1 Subunit of Shiga Toxin and Human GM-CSF: Assessment of Its immunogenicity and Toxicity," Iranian Biomedical Journal, 14(4):136-141 (2010).
Onda, M. et al., "An immunotoxin with greatly reduced immunogenicity by identification and removal of B cell epitopes," Proceedings of the National Academy of Sciences U.S.A., 105(32):11311-11316 (2008).
Osicka, R. et al., "Delivery of CD8+ T-cell epitopes into major histocompatibility complex class I antigen presentation," Infection and Immunity, 68(1):247-256 (2000).
Pai-Scherf, L. H. et al., "Hepatotoxicity in Cancer Patients Receiving erb-38, a Recombinant Immunotoxin that Targets the erbB2 Receptor," Clinical Cancer Research, 5(9):2311-2315 (1999).
Pastan, I. et al., "Immunotoxin Treatment of Cancer," Annual Review of Medicine, 58:221-237 (2007).
Paul, W. E. (Ed.) "Fundamental Immunology" 3rd Edition, Raven Press, 292-295 (1993).
Peng, K. W. et al., "Oncolytic measles viruses displaying a single-chain antibody against CD38, a myeloma cell marker," Blood, 101(7):2557-2562 (2003).
Perampalam, S. et al., "Designing combinatorial protein libraries based on a protein toxin template," Molecular & Cellular Proteomics, American Society for Biochemistry and Molecular Biology, Inc., US, vol. 2, No. 9, Jan. 11, 2003, p. 868.
Perampalam, S. et al., "Designing combinatorial protein libraries based on a protein toxin template," HUPO 2nd Annual & IUBMB IXI World Congress, Oct. 8-11, Montreal, Poster Session 28 Proteomics & Biotechnology, 80.16 (Oct. 2003).
Perampalam, S. et al., "Cell-targeted Ribosome-Inactivating Proteins derived from Protein Combinatorial Libraries," Thesis—University of Toronto (2008), 172 pages.
Peterson, J. K. et al., "Integrating pharmacology and in vivo cancer models in preclinical and clinical drug development," European Journal of Cancer, 40(6):837-844 (2004).
Pirie, C. M. et al., "Convergent Potency of Internalized Gelonin Immunotoxins across Varied Cell Lines, Antigens, and Targeting Moieties," Journal of Biological Chemistry, 286(6):4165-4172 (2011).
Pisarev, V. M. et al., "T cells recognize PD(N/T)R motif common in a variable No. of tandem repeat and degenerate repeat sequences of MUC1," International Immunopharmacology, 5(2):315-330 (2005).
Polito, L. et al., "The Conjugate Rituximab/saporin-S6 completely inhibits clonogenic growth of CD20-expressing cells and produces a synergistic toxic effect with Fludarabine," Leukemia 18(7):1215-1222 (2004).
Polito, L. et al., "Saporin-S6: A Useful Tool in Cancer Therapy," Toxins, 5:1698-1722 (2013).
Polson, A. G. et al., "Antibody-Drug Conjugates for the Treatment of Non-Hodgkin's Lymphoma: Target and Linker-Drug Selection," Cancer Research, 69(6):2358-2364 (2009).
Press, O. W. et al., "Endocytosis and Degradation of Monoclonal Antibodies Targeting Human B-Cell Malignancies," Cancer Research, 49(17):4906-4912 (1989).
Press, O. et al., "Retention of B-Cell Specific Monoclonal Antibodies by Human Lymphoma Cells," Blood, 83(5):1390-1397 (1994).
Preville, X, et al., "Eradication of Established Tumors by Vaccination With Recombinant Bordetella pertussis Adenylate Cyclase Carrying the Human Papillomavirus 16 E7 Oncoprotein," Cancer Research, 65(2):641-649 (2005).
Protein ID ABM97743, European Molecular Biology Laboratory (EMBL), Oloomi, M, et al., "synthetic construct partial A1-GMCSF chimeric protein", Sep. 10, 2007.
Promega Technical Reference, Amino Acids, 2018.
Rajagopalan, S. et al.,"CD-20 Specific Engineered Toxin Body Demonstrates Direct Cell Kill of Multiple B-Cell Non-Hodgkin's Lymphoma Types," Blood, 122(21):5152 (2013).
Rajagopalan, S. et al., "CD20-specific Engineered Toxin Body demonstrates direct cell kill of multiple B-cell Non-Hodgkin's lymphoma types," The Journal of Cancer Research, 74(19 Suppl): Abstract # 647, (Oct. 1, 2014); Proceedings: AACR Annual Meeting 2014 (Apr. 5-9, 2014).
Rajagopalan, S. et al., "CD20-specific Engineered Toxin Body demonstrates direct cell kill of multiple B-cell non-Hodgkin's lymphoma types," The Journal of Cancer Research, 74(19 Suppl): Abstract nr 647.
Rajagopalan, S, et al., "CD38-specific engineered toxin body: Therapeutic potential for multiple myeloma", The Journal of Cancer Research, 74(19 Suppl): Abstract #671, (Oct. 1, 2014) from American Association for Cancer Research (AACR) Annual Meeting 2014, (Apr. 5-9, 2014).
Rajagopalan, S. et al., "CD38-specific engineered toxin body: Therapeutic potential for multiple myeloma," The Journal of Cancer Research, 74(19 Suppl): Abstract nr 671 (Oct. 1, 2014).
Rajagopalan, S. et al., "HER2-targeted engineered toxin body demonstrates selective binding and cell kill of HER2-overexpressing breast cancer," The Journal of Cancer Research, 73(8 Suppl): Abstract #868 (Apr. 15, 2013).

(56) References Cited

OTHER PUBLICATIONS

Rajagopalan, S. et al., "HER2-targeted engineered toxin body demonstrates selective binding and cell kill of HER2-overexpressing breast cancer," Proceedings: American Association for Cancer Research (AACR) Annual Meeting 2013, Abstract #868 (Apr. 6-10, 2013).
Rajagopalan, S. et al., "Next-generation engineered toxin bodies: CD38, PD-L1 and HER2 targeted ETBs," American Association for Cancer Research (AACR) Annual Meeting, 2016, Abstract #595 (Apr. 16-20, 2016).
Rajagopalan, S. et al., "Next-generation engineered toxin bodies: CD38, PD-L1 and HER2 targeted ETBs," The Journal of Cancer Research, 76(14 Suppl) (Jul. 15, 2016), Abstract nr 595.
Rajagopalan, S. et al., "A novel targeted engineered toxin body for treatment of HER2 positive breast cancer," Thirty-Seventh Annual CTRC-AACR San Antonio Breast Cancer Symposium, nr P4-15-17 (Dec. 9-13, 2014).
Ramakrishnan, S. & Houston, L., "Comparison of the Selective Cytotoxic Effects of Immunotoxins Containing Ricin A Chain or Pokeweed Antiviral Protein and Anti-Thy 1.1 Monoclonal Antibodies," Cancer Research, 44(1):201-208 (1984).
Ramos, H. J. et al., Abstract 3900, "The safety and efficacy profile of a PD-L1 directed, Engineered Toxin Body, as a novel targeted direct-cell kill approach for the treatment of PD-L1 expressing cancers," Molecular Templates, AACR Annual Meeting 2019; Mar. 29-Apr. 3, 2019; Atlanta, GA, AACR2019, 2 pages.
Robinson, G. L. et al., "In vivo efficacy of a CD38-specific engineered toxin body," Clinical Cancer Research, 21(17 Suppl) (Sep. 21, 2015), Abstract A15.
Robinson, G. L. et al., "In vivo efficacy of a CD38-specific engineered toxin body," Proceedings: American Association for Cancer Research (AACR) Special Conference on Hematologic Malignancies: Translating Discoveries to Novel Therapies, Poster A15 (Sep. 21, 2015).
Robinson, G. L. et al., "MT-3724, an engineered toxin body targeting CD20 for non-Hodgkin's lymphoma," Proceedings: American Association for Cancer Research (AACR) 107th Annual Meeting 2016, Abstract #1483 (Apr. 6-10, 2016).
Robinson, G. L. et al., "MT-4019: a de-immunized engineered toxin body targeting CD38 for multiple myeloma," Proceedings: American Association for Cancer Research (AACR) Annual Meeting 2017, Poster, Abstract 2659 (Apr. 1-5, 2017).
Robinson, G. L. et al., "MT-3724, an engineered toxin body targeting CD20 for non-Hodgkin's lymphoma," Proceedings of the 107th Annual Meeting of the American Association for Cancer Research, Cancer Research, Jul. 15, 2016, 76(14 Suppl), Abstract 1483.
Romaniuk, S. I. et al., "Recombinant Diphtheria toxin derivatives: Perspectives of application," Russian Journal of Bioorganic Chemistry, 38(6):565-577 (2012).
Rosenthal, A. et al., "A phase 2 study of lenalidomide, rituximab, cyclophosphamide, and dexamethasone (LR-CD) for untreated low-grade non-Hodgkin lymphoma requiring therapy," Am J Hematol., 92(5):467-472 (2017).
Rossi, E. A. et al., "Novel Designs of Multivalent Anti-CD20 Humanized Antibodies as Improved Lymphoma Therapeutics," Cancer Research, 68(20):8384-8392 (2008).
Roudkenar, M. H. et al., "Selective cytotoxicity of recombinant STXA1-GM-CSF protein in hematopoietic cancer cells," Cell Biology and Toxicology, 22(3):213-219 (2006).
Rudikoff, S. et al., "Single amino acid substitution altering antigen-binding specificity," Proceedings of the National Academy of Sciences of the USA, 79(6):1979-1983 (1982).
Saijo, N. "What are the reasons for negative phase III trials of molecular-target-based drugs?" Cancer Science 95(10):772-776 (2004).
Sandvig, K. et al., "Protein toxins: mode of action and cell entry," Biochemical Society Transactions, 20(4):724-727 (1993).
Sandvig, K. et al., "Entry of Shiga Toxin into Cells," Zentralblatt für Bakteriologie, 278(2-3):296-305 (1993).
Saron, M. F. et al., "Anti-viral protection conferred by recombinant adenylate cyclase toxins from Bordetella pertussis carrying a CD8+ T cell epitope from lymphocytic choriomeningitis virus," Proceedings of the National Academy of Sciences U.S.A., 94(7):3314-3319 (1997).
Schindler, J. et al., "A Phase I Study of a Combination of anti-CD19 and anti-CD22 Immunotoxins (Combotox) in Adult Patients with Refractory B-Lineage Acute Lymphoblastic Leukemia," British Journal of Haematology, 154(4):1-11 (2011).
Schlecht, G. et al., "Antigen Targeting to CD11b Allows Efficient Presentation of CD4+ and CD8+ T Cell Epitopes and In Vivo Th1-Polarized T Cell Priming," The Journal of Immunology, 173(10):6089-6097 (2004).
Schuh, J. C., "Trials, Tribulations, and Trends in Tumor Modeling in Mice," Toxicologic Pathology, 32(Suppl. 1):53-66 (2004).
Schultz, J. C. et al., "A Tetravalent Single-chain Antibody-Streptavidin Fusion Protein for Pretargeted Lymphoma Therapy," Cancer Research, 60(23):6663-6669 (2000).
Schumacher, F.-R. et al., "Building proteomic tool boxes to monitor MHC class I and class II peptides," Proteomics, 17(1-2):1600061 (2017), 16 pages; doi:10.1002/pmic.201600061.
Sebo, P. et al., "Cell-Invasive Activity of Epitope-Tagged Adenylate Cyclase of Bordetella pertussis allows In Vitro Presentation of a Foreign Epitope to CD8+ Cytotoxic T Cells," Infection and Immunity, 63(10):3851-3857 (1995).
Sebo, P. et al., "In vivo induction of CTL responses by recombinant adenylate cyclase of Bordetella pertussis carrying multiple viral CD8+ T-cell epitope," FEMS Immunology & Medical Microbiology, 26(2):167-173 (1999).
Shan, D. et al., "Characterization of scFV-Ig Constructs Generated from the Anti-CD20 mAb 1F5 Using Linker Peptides of Varying Lengths," Journal of Immunology, 162(11):6589-6595 (1999).
Shaw, C. A. et al., "Stimulation of CD8+ T Cells following Diphtheria Toxin-Mediated Antigen Delivery into Dendritic Cells," Infection and Immunity, 74(2):1001-1008 (2006).
Shen, G. L. et al., "Evaluation of four CD22 antibodies as ricin A chain-containing immunotoxins for the in vivo therapy of human B-cell leukemias and lymphomas," International Journal of Cancer, 42(5):792-797 (1988).
Shete, V., "Generation and characterization of random site-directed mutants of Shiga-like toxin 1A by *Escherichia coli* O157:H7 in *Saccharomyces cerevisiae*," Thesis, Rutgers, The State University of New Jersey, New Brunswick (2009), retrieved from http://dx.doi.org/doi:10.7282/T300029Z.
Shiba, Y. et al., "AGAP2 regulates retrograde transport between early endosomes and the TGN," Journal of Cell Science, 123(Pt 14):2381-2390 (2010).
Sieber, T. et al., "Selective internalization of monoclonal antibodies by B-cell chronic lymphocytic leukemia cells," 121(3):458-461 (2003).
Simsova, M. et al., "The adenylate cyclase toxin from Bordetella pertussis—a novel promising vehicle for antigen delivery to dendritic cells," International Journal of Medical Microbiology, 239:571-576 (2004).
Singh, N. K. et al., "Emerging Concepts in TCR Specificity: Rationalizing and (Maybe) Predicting Outcomes," J Immunol, 199:2203-2213 (2017).
Sivam, G. et al., "Immunotoxin to a Human Melanoma-associated Antigen: Comparison of Gelonin with Ricin and Other A Chain Conjugates," Cancer Research, 47(12):3169-3173 (1987).
Skinner, L. M. & Jackson, M. P., "Investigation of ribosome binding by the Shiga Toxin A1 subunit, using competition and site-directed mutagenesis," Journal of Bacteriology, 179(4): 1368-1374 (1997).
Skinner, L. M. & Jackson, M. P., "Inhibition of prokaryotic translation by the Shiga toxin enzymatic subunit," Microbial Pathogenesis, 24(2):117-122 (1998).
Smith, D. C. et al., "Exogenous Peptides Delivered by Ricin Require Processing by Signal Peptidase for Transporter Associated with Antigen Processing-Independent MHO Class I-Restricted Presentation," The Journal of Immunology, 169(1):99-107 (2002).
Stenmark, H. et al., "Peptides fused to the amino-terminal end of Diphtheria toxin are translocated to the cytosol," The Journal of Cell Biology, 113(5):1025-1032 (1991).

(56) References Cited

OTHER PUBLICATIONS

Stepanov, A. et al., "Design of Targeted B Cell Killing Agents," PLoS One, 6(6):e20991 (2011); doi:10.1371/journal.pone.0020991, 10 pages.
Strop, P. et al., "Location Matters: Site of Conjugation Modulates Stability and Pharmacokinetics of Antibody Drug Conjugates," Chemistry & Biology, 20:161-167 (2013).
Su, H. et al., "Clinical grade production and characterization of a fusion protein comprised of the chemokine CCL2-ligand genetically fused to a mutated and truncated form of the Shiga A1 subunit," Protein Expression and Purification, 66(2):149-157 (2009).
Suh, J. K. et al., "Shiga Toxin Attacks Bacterial Ribosomes as Effectively as Eucaryotic Ribosomes," Biochemistry, 37(26):9394-9398 (1998).
Suhan, M. L. et al., "Disruption of an Internal Membrane-Spanning Region in Shiga Toxin I Reduces Cytotoxicity," Infection and Immunity, 66(11):5252-5259 (1998).
Tacken, P. J. et al., "Effective induction of naive and recall T-cell responses by targeting antigen to human dendritic cells via a humanized anti-DC-SIGN antibody," Blood, 106(4): 1278-85 (2005).
Tesh, V. L. et al., "Comparison of the Relative Toxicities of Shiga-Like Toxins Type I and Type II for Mice," Infection and Immunity, 61(8):3392-3402 (1993).
Thompson, J. et al., "Improved binding of a bivalent single-chain immunotoxin results in increased efficacy for in vivo T-cell depletion," Protein Engineering, 14(12):1035-1041 (2001).
Thorpe, P. E. et al., "Cytotoxicity Acquired by Conjugation of an Anti-Thy1.1 Monoclonal Antibody and the Ribosome-Inactivating Protein, Gelonin," European Journal of Biochemistry, 116(3):447-454 (1981).
Torgersen, M. L. et al., "The A-subunit of surface-bound Shiga toxin stimulates clathrin-dependent uptake of the toxin," The FEBS Journal, 272(16):4103-4013 (2005).
Tosatto, C. E. et al., "Large-Scale Prediction of Protein Structure and Function from Sequence," Current Pharmaceutical Design, 12(17):2067-2086 (2006).
Vallera, D. A. et al., "Bioengineering a unique deimmunized bispecific targeted toxin that simultaneously recognizes human CD22 and CD19 Receptors in a mouse model of B-Cell metastases," Molecular Cancer Therapeutics, 9(6):1872-1883 (2010).
Varner, C. T. et al., "Recent Advances in Engineering Polyvalent Biological Interactions," Biomacromolecules, 16(1):43-55 (2014).
Vernet, E. et al., "Affinity-based entrapment of the HER2 receptor in the endoplasmic reticulum using an affibody molecule," Journal of Immunological Methods, 338:1-6 (2008).
Vervoordeldonk, S. F. et al., "Preclinical studies with radiolabeled monoclonal antibodies for treatment of patients with B-cell malignancies," Cancer, 73(3):1006-1011 (1994).
Vingert, B. et al., "The Shiga toxin B-subunit targets antigen in vivo to dendritic cells and elicits anti-tumor immunity," European Journal of Immunology, 36(5):1124-1135 (2006).
Von Minckwitz, G. et al., "Phase I clinical study of the recombinant antibody toxin scFv(FRP5)-ETA specific for the ErbB2/HER2 receptor in patients with advanced solid malignomas," Breast Cancer Research, 7(5):R617-R626 (2005).
Voskoglou-Nomikos, T. et al., "Clinical Predictive Value of the In Vitro Cell Line, Human Xenograft, and Mouse Allograft Preclinical Cancer Models," Clinical Cancer Research, 9(11): 4227-4239 (2003).
Wales, R. et al., "Addition of an endoplasmic reticulum retrieval sequence to ricin A chain significantly increases its cytotoxicity to mammalian cells," Journal of Biological Chemistry, 268(32):23986-23990 (1993).
Wang, E. et al., "T-cell-directed cancer vaccines: the melanoma model," Expert Opinion on Biological Therapy, 1(2):277-290 (2001).
Wargalla, U. D. & Reisfeld, R. A., "Rate of internalization of an immunotoxin correlates with cytotoxic activity against human tumor cells," PNAS USA, 86(13):5146-5150 (1989).
Weinstein, D. et al., "In vivo formation of hybrid toxins comprising Shiga toxin and the Shiga-like toxins and role of the B subunit in localization and cytotoxic activity," Infection and Immunity, 57(12):3743-3750 (1989).
Weldon, J. E. & Pastan, I., "A guide to taming a toxin: recombinant immunotoxins constructed from *Pseudomonas* exotoxin A for the treatment of cancer," FEBS Journal, 278(23):4683-4700 (2011).
Willert, E. K. et al., "Engineered toxin bodies: A next-generation immunotoxin scaffold with novel immunooncology functionality," Proceedings: American Association for Cancer Research (AACR) Annual Meeting 2015, Abstract #2477 (Apr. 18-22, 2015).
Willert, E. K. et al., "A novel targeted engineered toxin body for treatment of HER2 positive breast cancer," The Journal of Cancer Research, 75(9 Suppl) Abstract nr P4-15-17 (May 1, 2015).
Willert, E. K. et al., "Engineered toxin bodies: A next-generation immunotoxin scaffold with novel immunooncology functionality," The Journal of Cancer Research, 75(15 Suppl): Abstract nr 2477 (Aug. 1, 2015).
Willert, E. K. et al., "TAK-169, an exceptionally potent CD38 targeted engineered toxin body, as a novel direct cell kill approach for the treatment of multiple myeloma," Proceedings: American Association for Cancer Research (AACR) Annual Meeting 2019, Poster #2384 (Apr. 1, 2019).
Windschiegl, B. et al., "Lipid Reorganization Induced by Shiga Toxin Clustering on Planar Membranes," PLoS One, 4(7):e6238 (2009).
Wirth, R. et al., "Engineered Toxin Body demonstrating CD20-specific binding and cell kill in B-Cell Non-Hodgkin lymphoma cells," Proceedings: American Association for Cancer Research (AACR) 104th Annual Meeting 2013, Abstract #5477 (Apr. 6-10, 2013).
Wirth, R. et al., "Engineered Toxin Body demonstrating CD20-specific binding and cell kill in B-Cell Non-Hodgkin lymphoma cells," [Abstract], In: Proceedings of the 104th Annual Meeting of the American Association for Cancer Research, Cancer Research, Apr. 15, 2013, 73(8 Suppl) Abstract #5477.
Wu, A. M. et al.,"Multimerization of a chimeric anti-CD20 single chain Fv-Fc fusion protein is mediated through variable domain exchange," Protein Engineering, 14(12):1025-1033 (2001).
Wu, H. et al., "Humanization of a murine monoclonal antibody by simultaneous optimization of framework and CDR residues," J. Mol. Biol., 294:151-162 (1999).
Yamasaki, S. et al., "Importance of arginine at position 170 of the A subunit of Vero toxin 1 produced by enterohemorrahagic *Escherichia coli* for toxin activity," Microbial Pathogenesis, 11(1):1-9 (1991).
Yu, L. et al., "Interaction between bevacizumab and murine VEGF-A: a reassessment," Investigative Ophthalmology & Visual Science, 49(2):522-527 (2008).
Zacny, V. et al., "Novel toxin library for the discovery of oncology therapeutics," Cancer Research, 70(8 Suppl), Abstract #5506 (Apr. 2010).
Zahid, M. et al., "Design and reshaping of an scFv directed against human platelet glycoprotein VI with diagnostic potential," Analytical Biochemistry, 417(2):274-282 (2011).
Zapata, G. et al., "Engineering linear F(ab')2 fragments for efficient production in *Escherichia coli* and enhanced antiproliferative activity," Protein Engineering, 8(10):1057-1062 (1995).
Edelman, G. M. & Gally, J. A., "Degeneracy and complexity in biological systems," PNAS, 98(24):13763-13768 (2001).
Muzard, J. et al., "Grafting of protein L-binding activity onto recombinant antibody fragments," Analytical Biochemistry, 388(2):331-338 (2009).
Nilson, B. H. K. et al., "Protein L from Peptostreptococcus magnus binds to the kappa light chain variable domain," Journal of Biological Chemistry, 267(4):2234-2239 (1992).
Nilson, B. H. K. et al., "Purification of antibodies using protein L-binding framework structures in the light chain variable domain," Journal of Immunological Methods, 164(1):33-40 (1993).
Wels, W. et al., "Selective Inhibition of Tumor Cell Growth by a Recombinant Single-Chain Antibody-Toxin Specific for the erbB-2 Receptor," Cancer Research, 52:6310-6317 (1992).
U.S. Appl. No. 16/540,789, filed Aug. 14, 2019.
U.S. Appl. No. 17/030,657, filed Sep. 24, 2020.

(56) References Cited

OTHER PUBLICATIONS

U.S. Appl. No. 15/899,428, filed Feb. 20, 2018.
U.S. Appl. No. 16/480,591, filed Jul. 24, 2019.
U.S. Appl. No. 17/228,579, filed Apr. 12, 2021.
U.S. Appl. No. 16/467,737, filed Jun. 7, 2019.
U.S. Appl. No. 17/314,563, filed May 7, 2021.
U.S. Appl. No. 16/220,468, filed Dec. 14, 2018.
U.S. Appl. No. 17/231,526, filed Apr. 15, 2021.
U.S. Appl. No. 15/125,126, filed Sep. 9, 2016.
U.S. Appl. No. 15/114,487, filed Jul. 27, 2016.
U.S. Appl. No. 15/125,142, filed Sep. 9, 2016.
U.S. Appl. No. 16/013,600, filed Jun. 20, 2018.
U.S. Appl. No. 17/027,120, filed Sep. 21, 2020.

* cited by examiner

Figure 1. Schematic Drawing of Exemplary, Shiga Toxin Effector Polypeptides and Cell-Targeting Molecules of the Present Invention
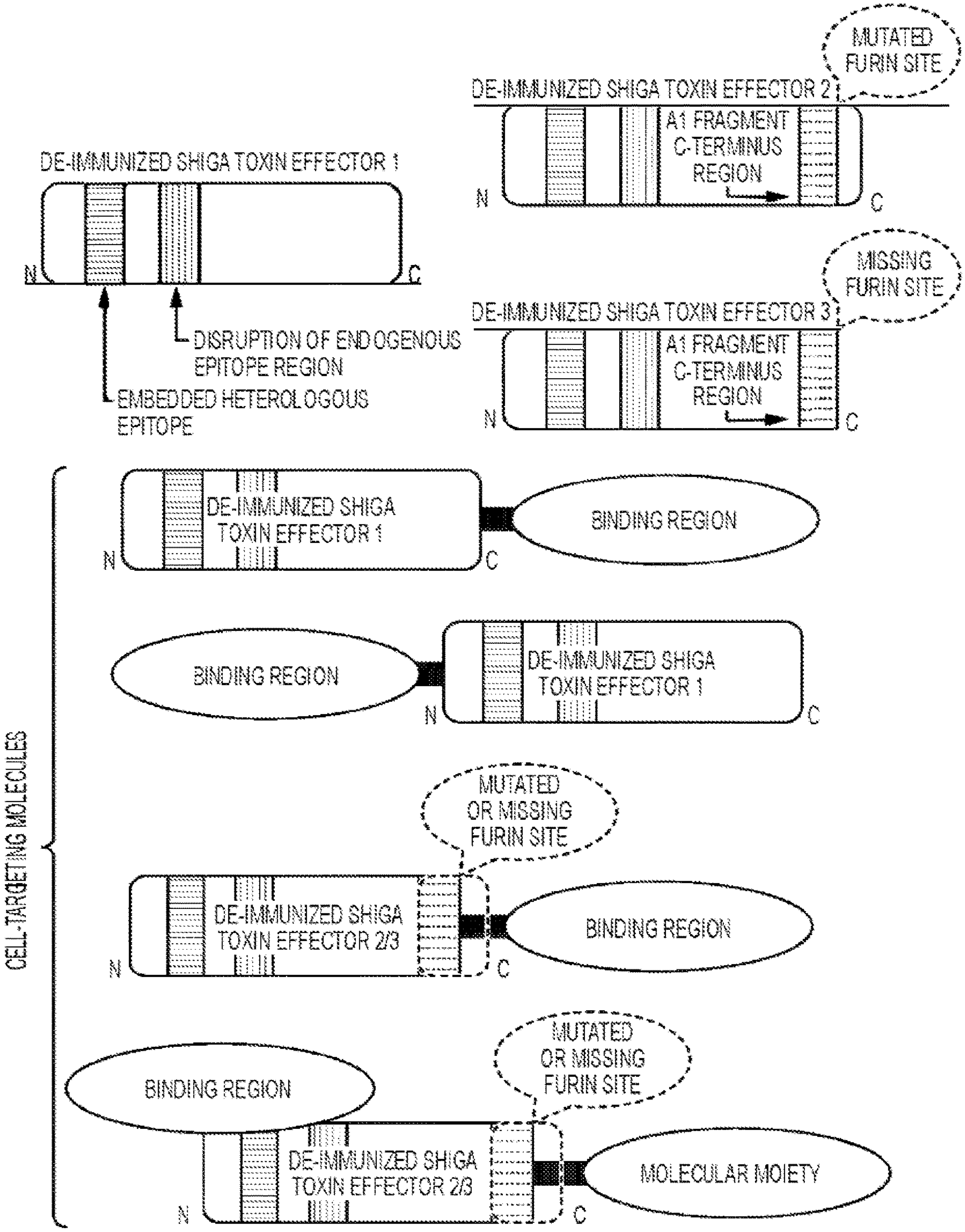

Figure 2. *In Vitro* Ribosome Inhibition Activities of Exemplary Cell-Targeting Molecules of the Invention
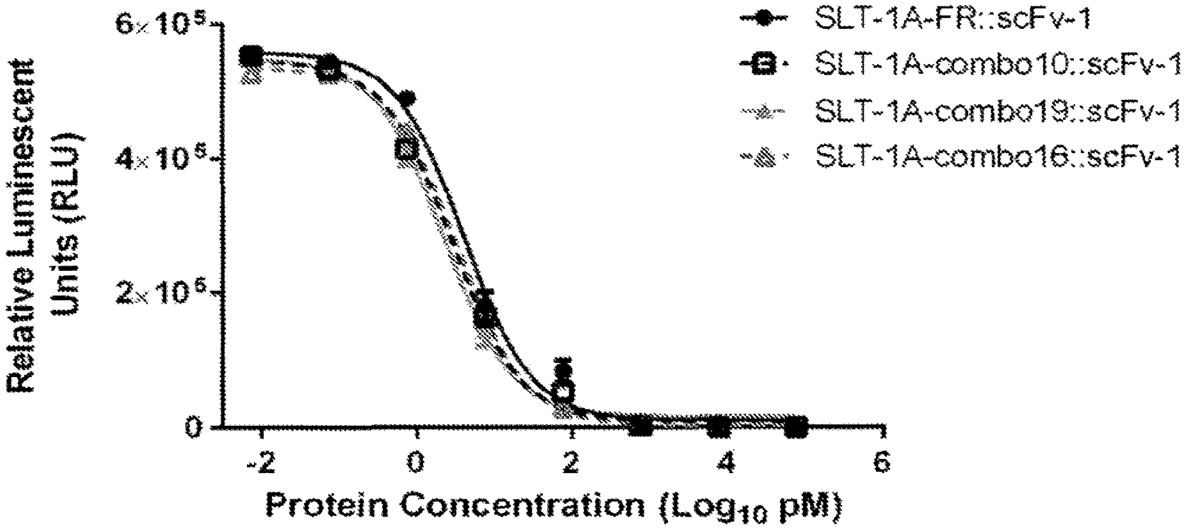

Figure 3. Cytotoxic Activities of Exemplary Cell-Targeting Molecules of the Invention
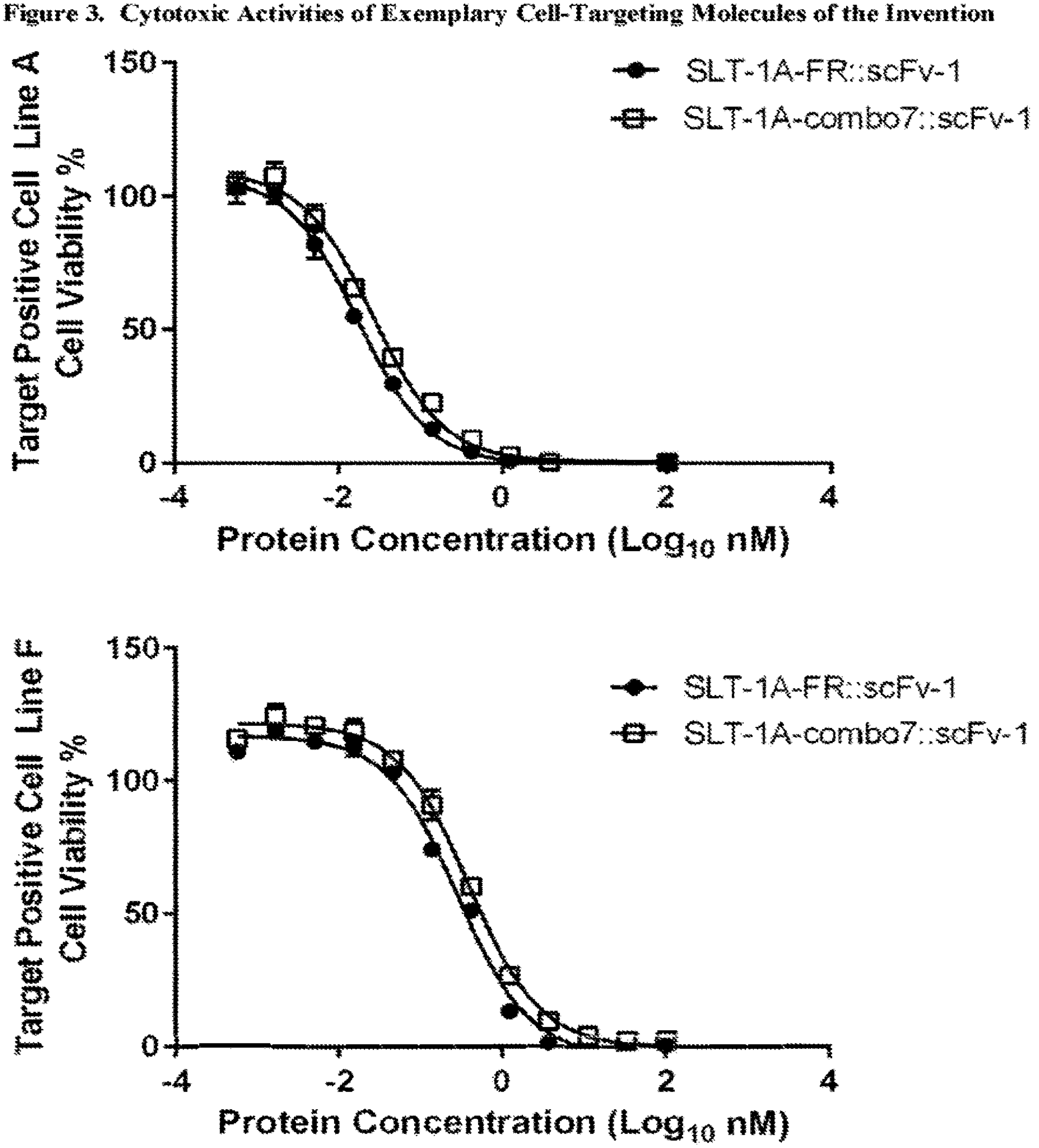

Figure 4. Cytotoxic Activities of Exemplary Cell-Targeting Molecules of the Invention
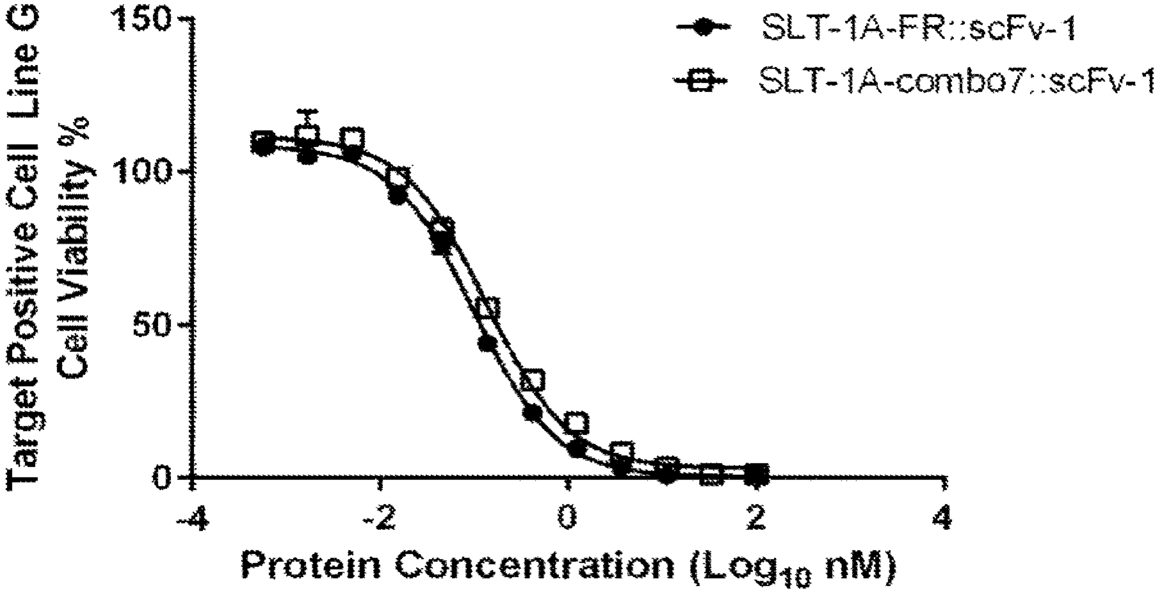
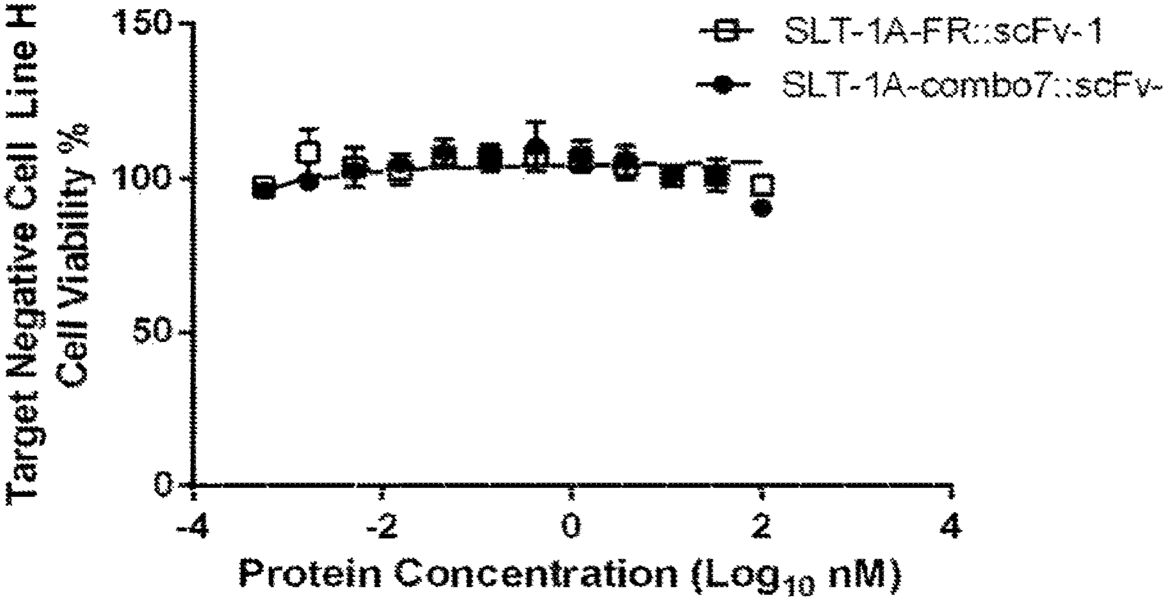

Figure 5. Cytotoxic Activities of Exemplary Cell-Targeting Molecules of the Invention
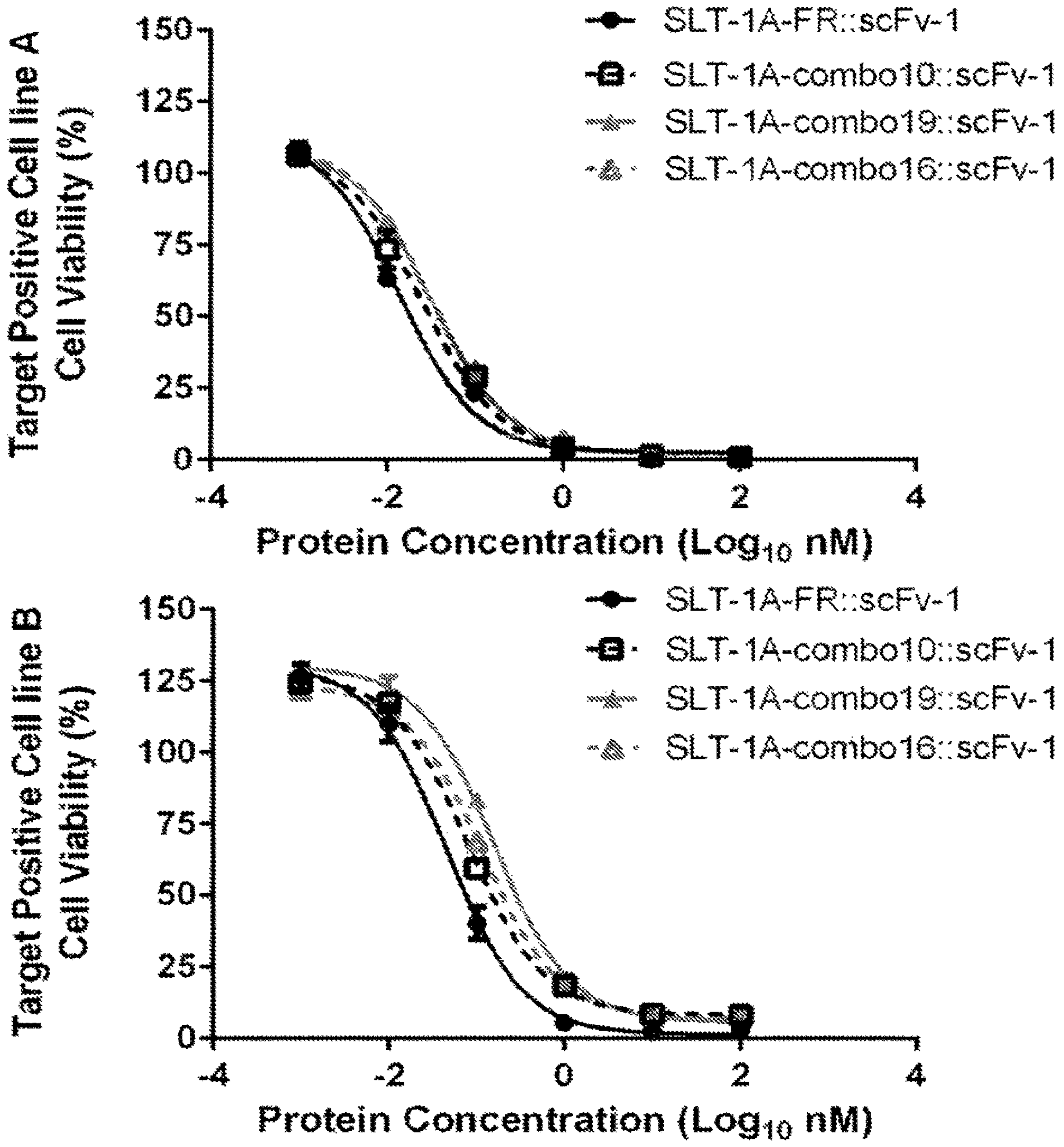

Figure 6. Cytotoxic Activities of Exemplary Cell-Targeting Molecules of the Invention
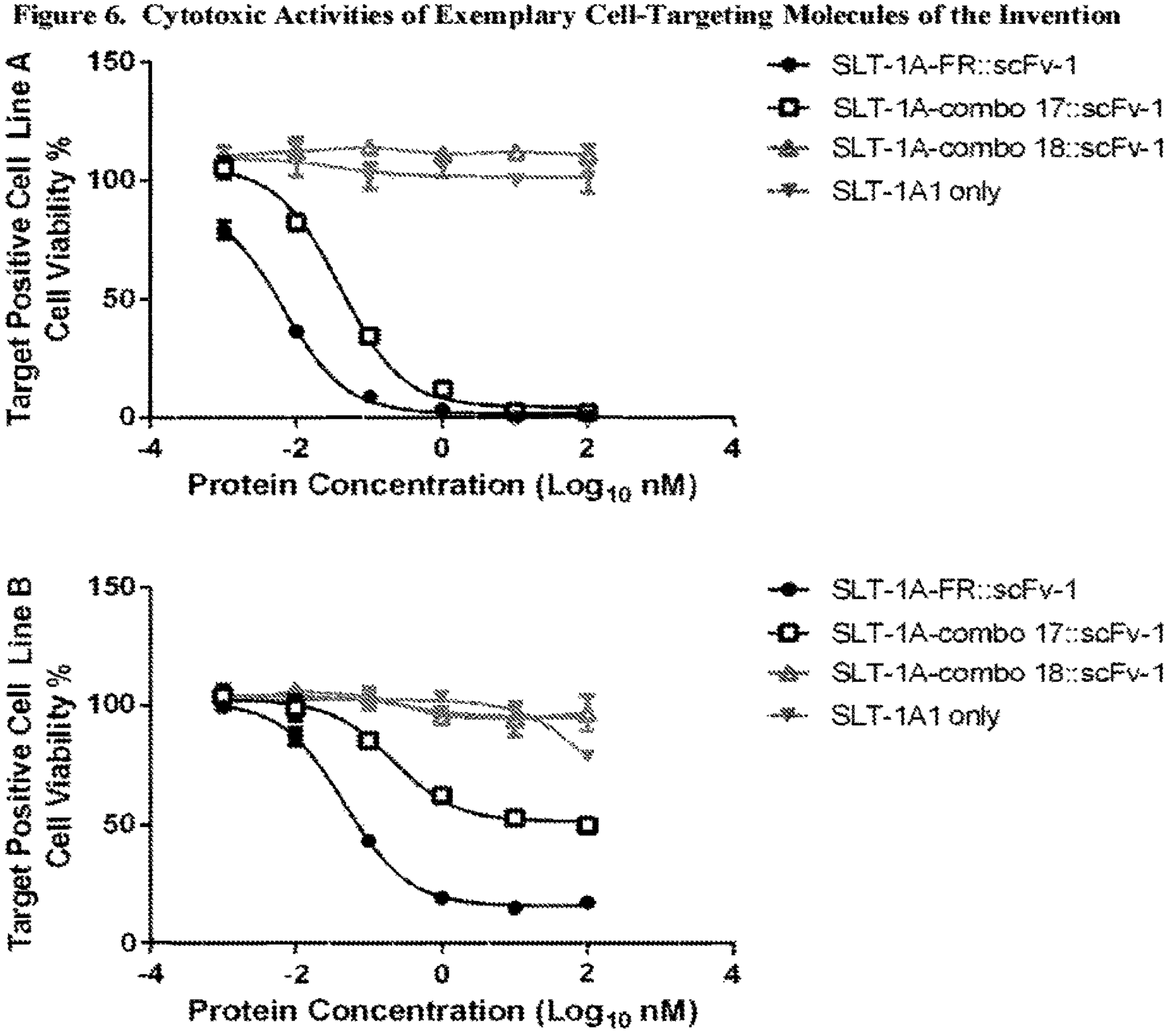

Figure 7. Cytotoxic Activities of Exemplary Cell-Targeting Molecules of the Invention
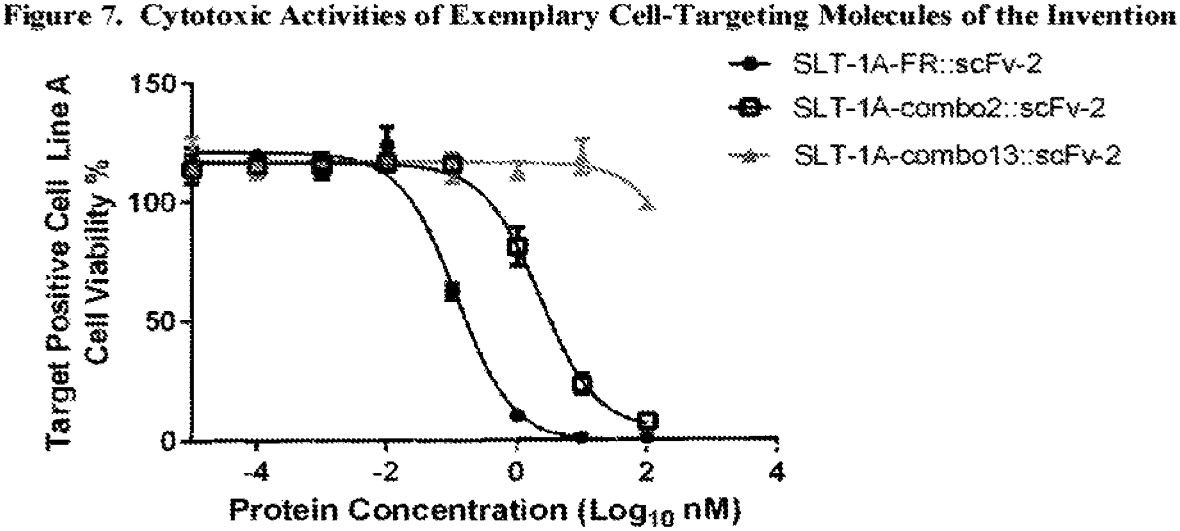
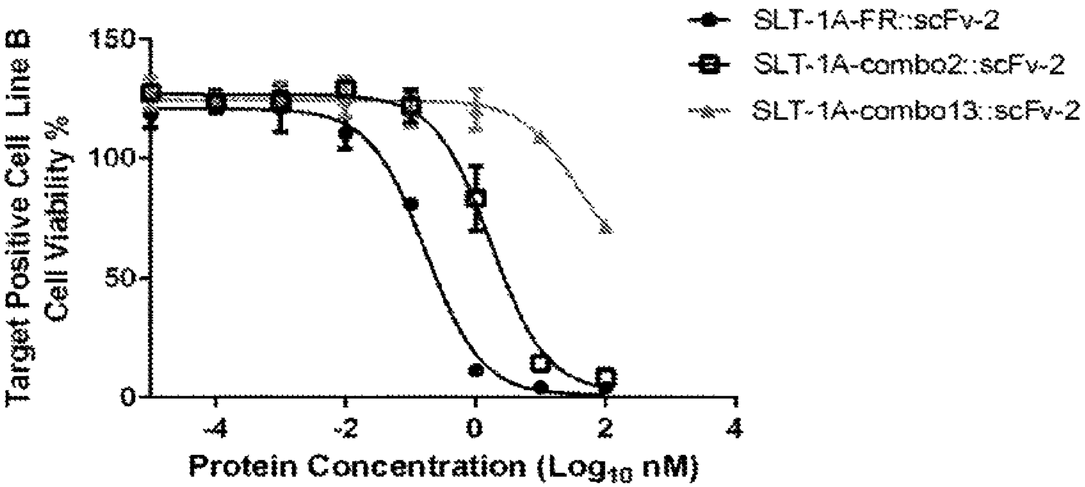
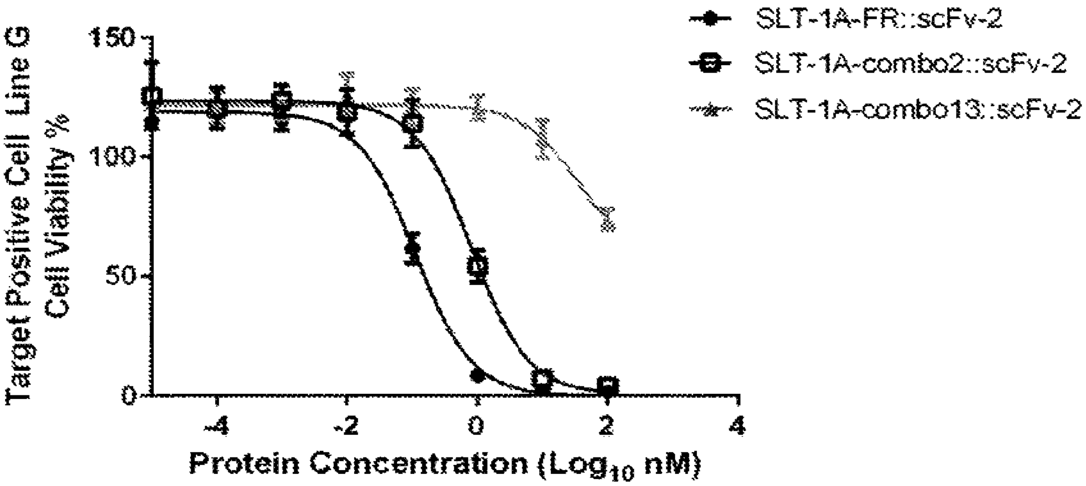

Figure 8. Cytotoxic Activities of Exemplary Cell-Targeting Molecules of the Invention
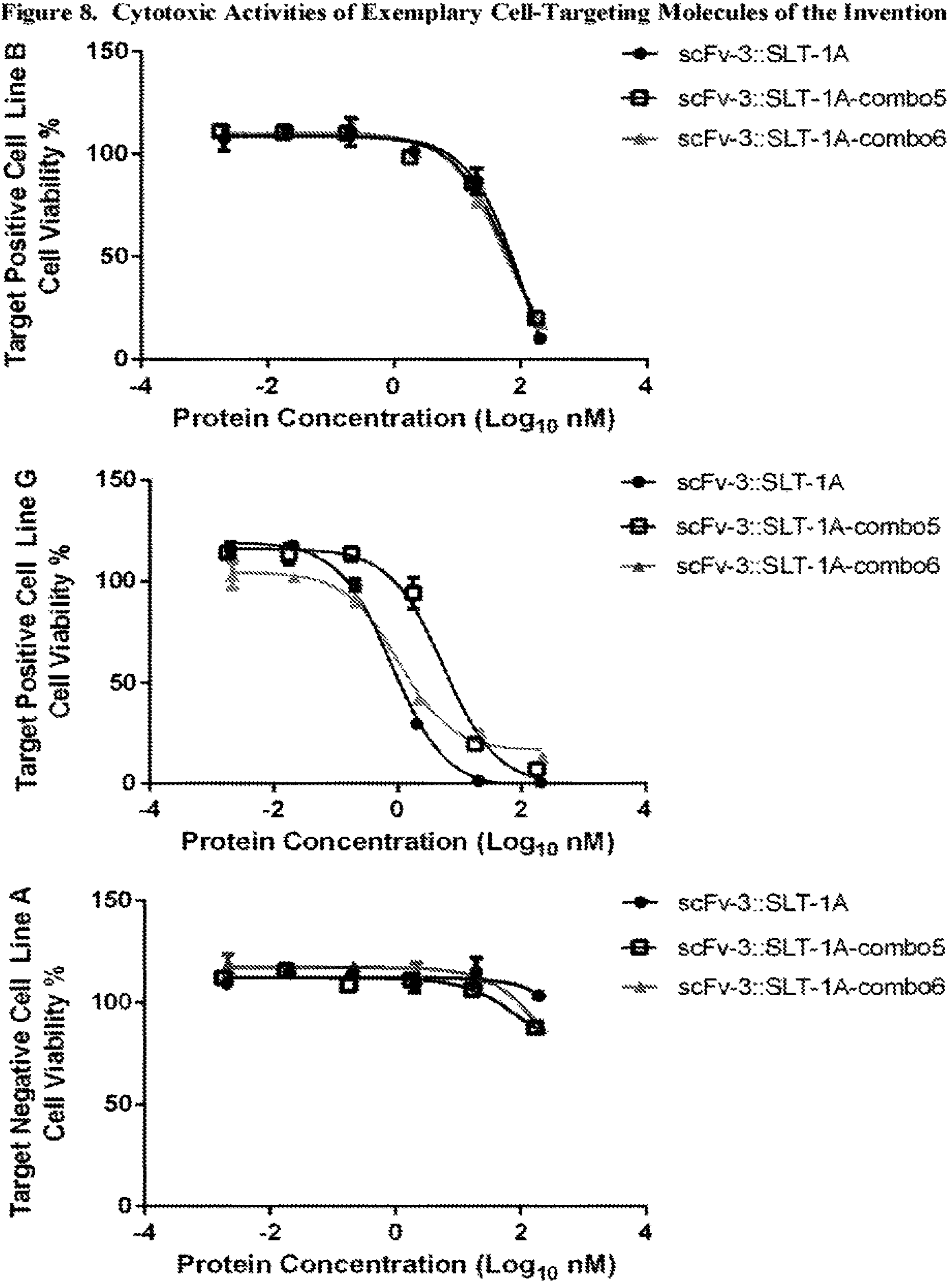

Figure 9. Cytotoxic Activities of Exemplary Cell-Targeting Molecules of the Invention
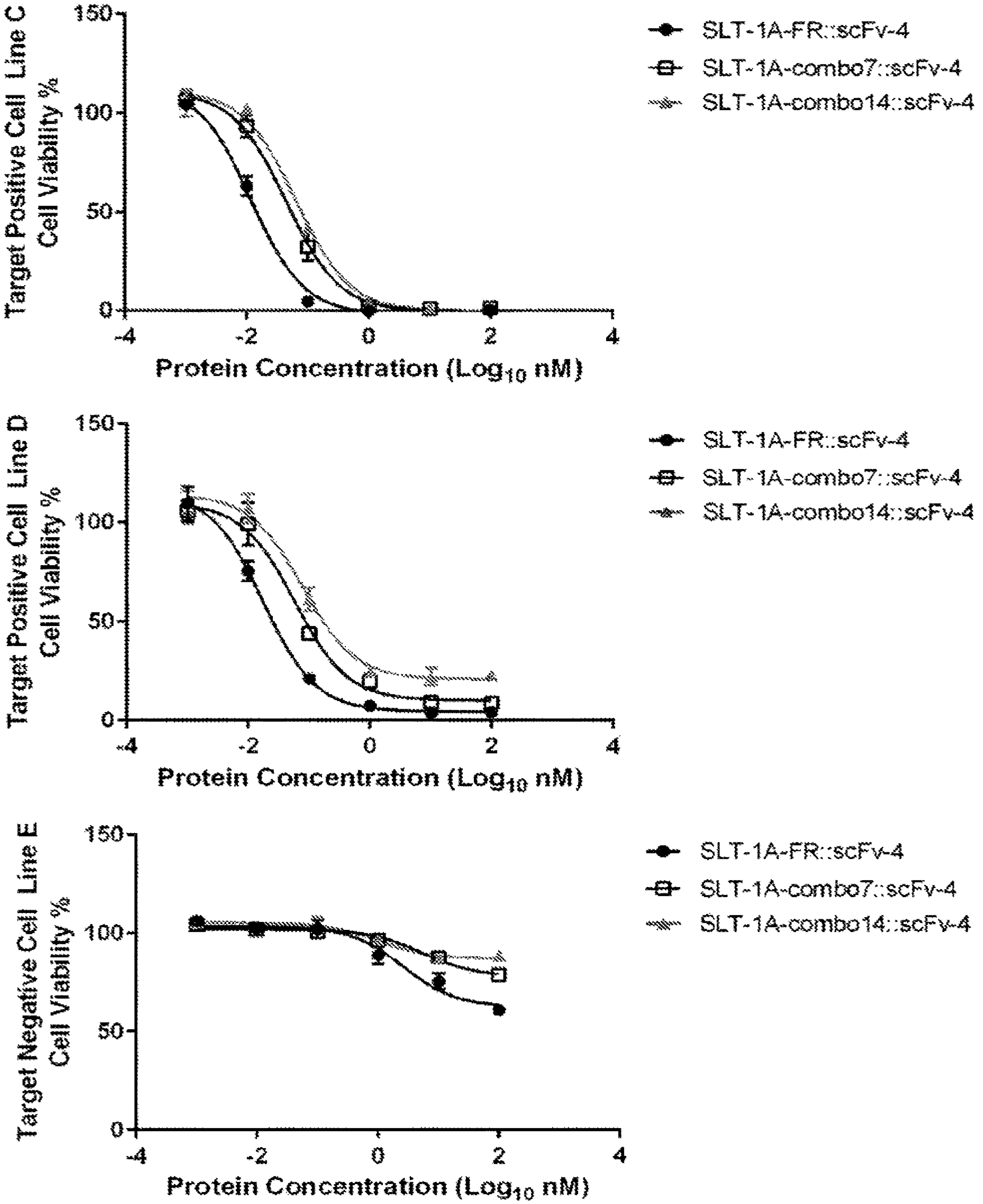

Figure 10. Cytotoxic Activities of Exemplary Cell-Targeting Molecules of the Invention
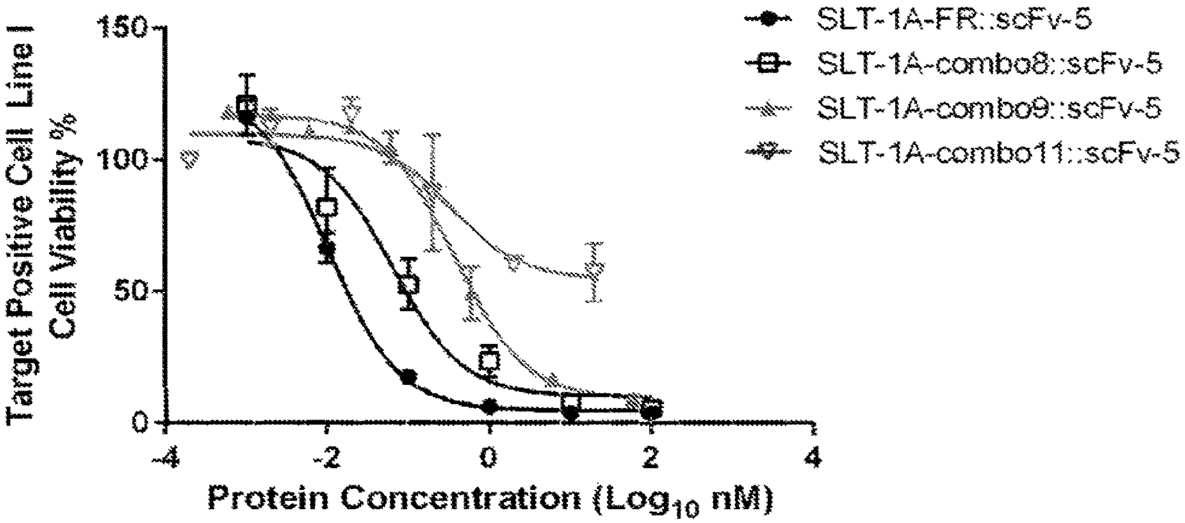

Figure 11. Caspase Activity Induced by Exemplary Cell-Targeting Molecules of the Invention
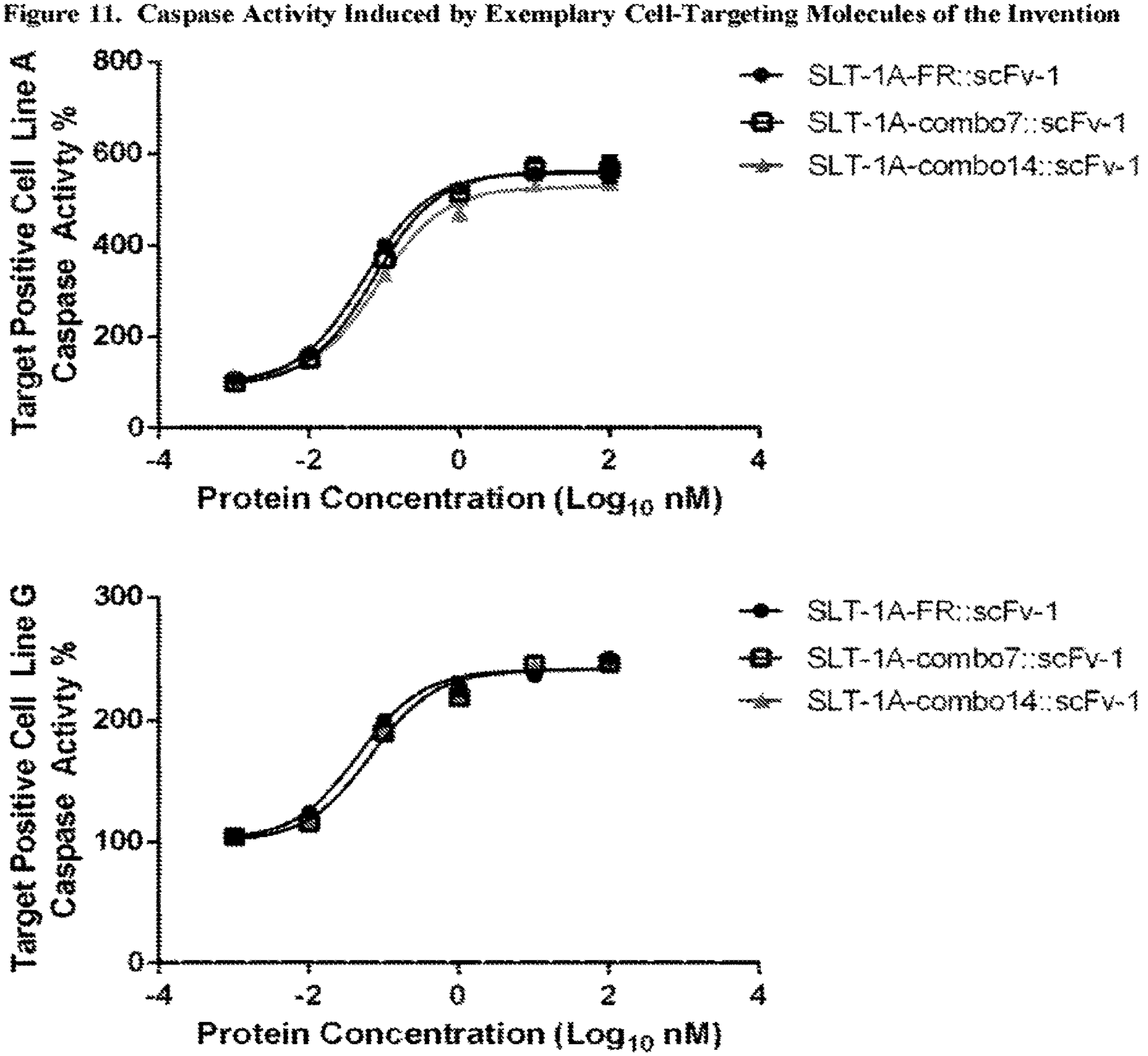

Figure 12. Caspase Activity Induced by an Exemplary Cell-Targeting Molecule of the Invention
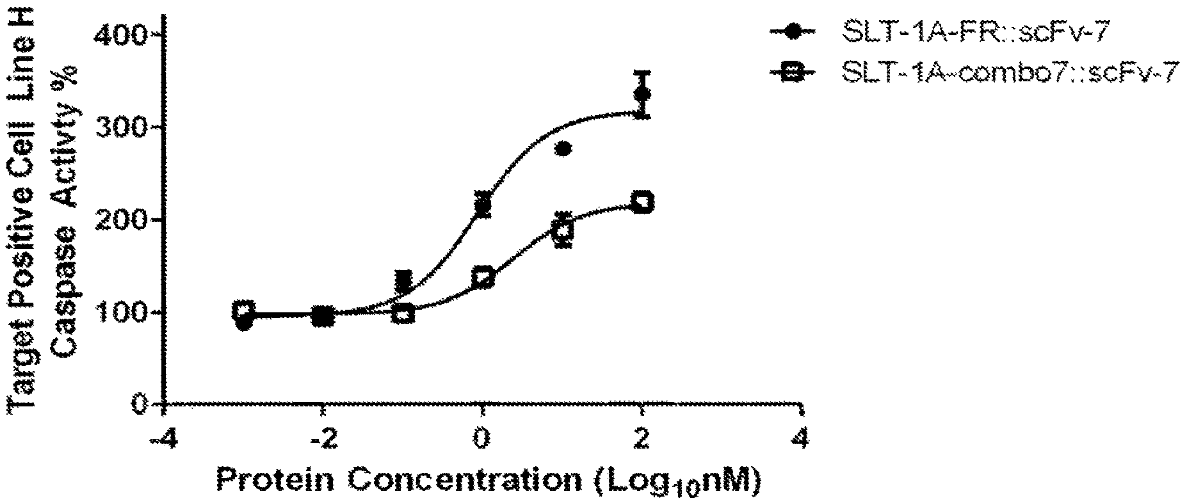
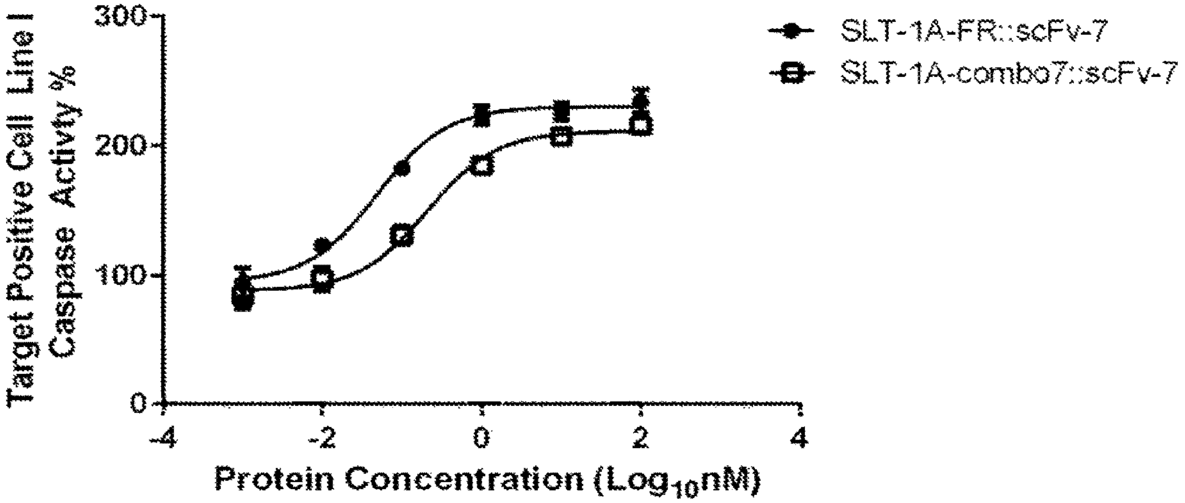

Figure 13. Relative Antigenicities of Exemplary Cell-Targeting Molecules of the Invention under denaturing conditions in Western Blots
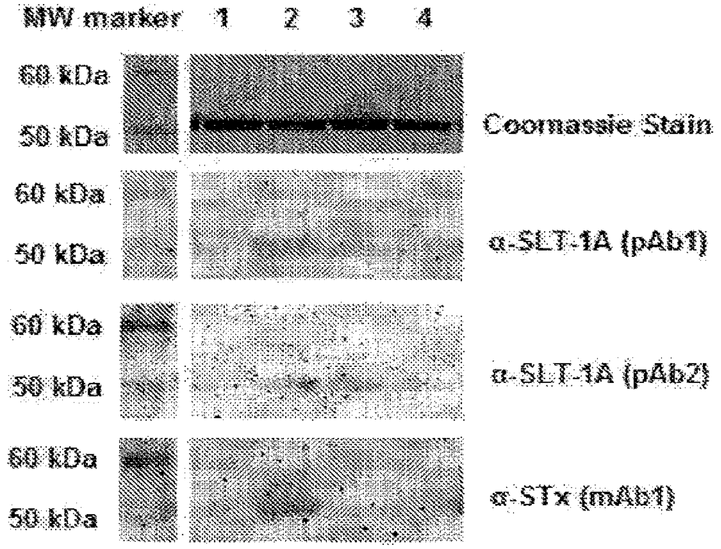
1. SLT-1A-combo7::scFv-1
2. SLT-1A-FR::scFv-1
3. SLT-1A-combo14::scFv-1
4. SLT-1A-combo10::scFv-1
Figure 14. Relative Antigenicities of Exemplary Cell-Targeting Molecules of the Invention under native conditions in ELISAs
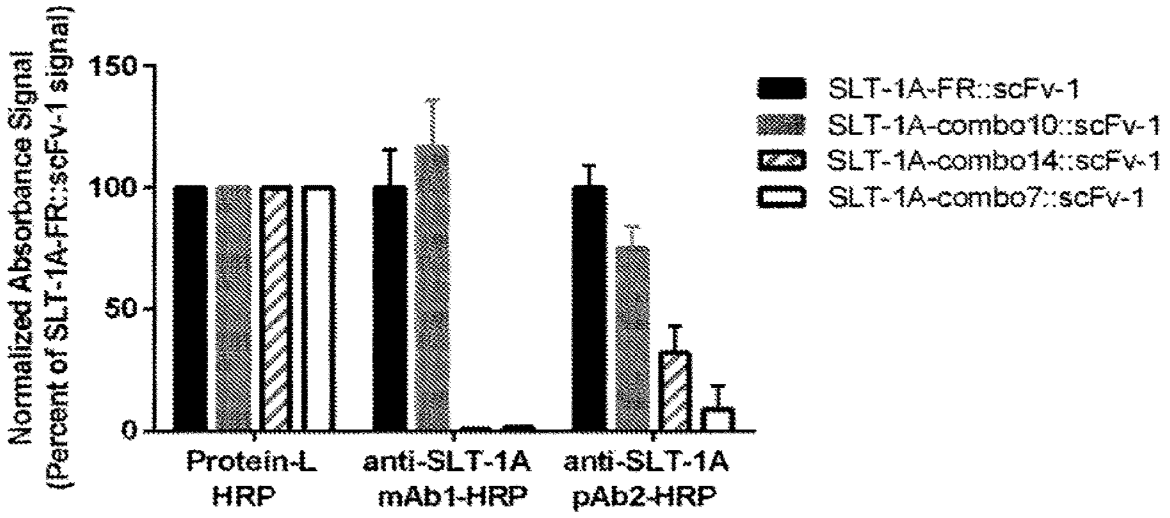

Figure 15. Relative Immunogenicities of Exemplary Cell-Targeting Molecules of the Invention
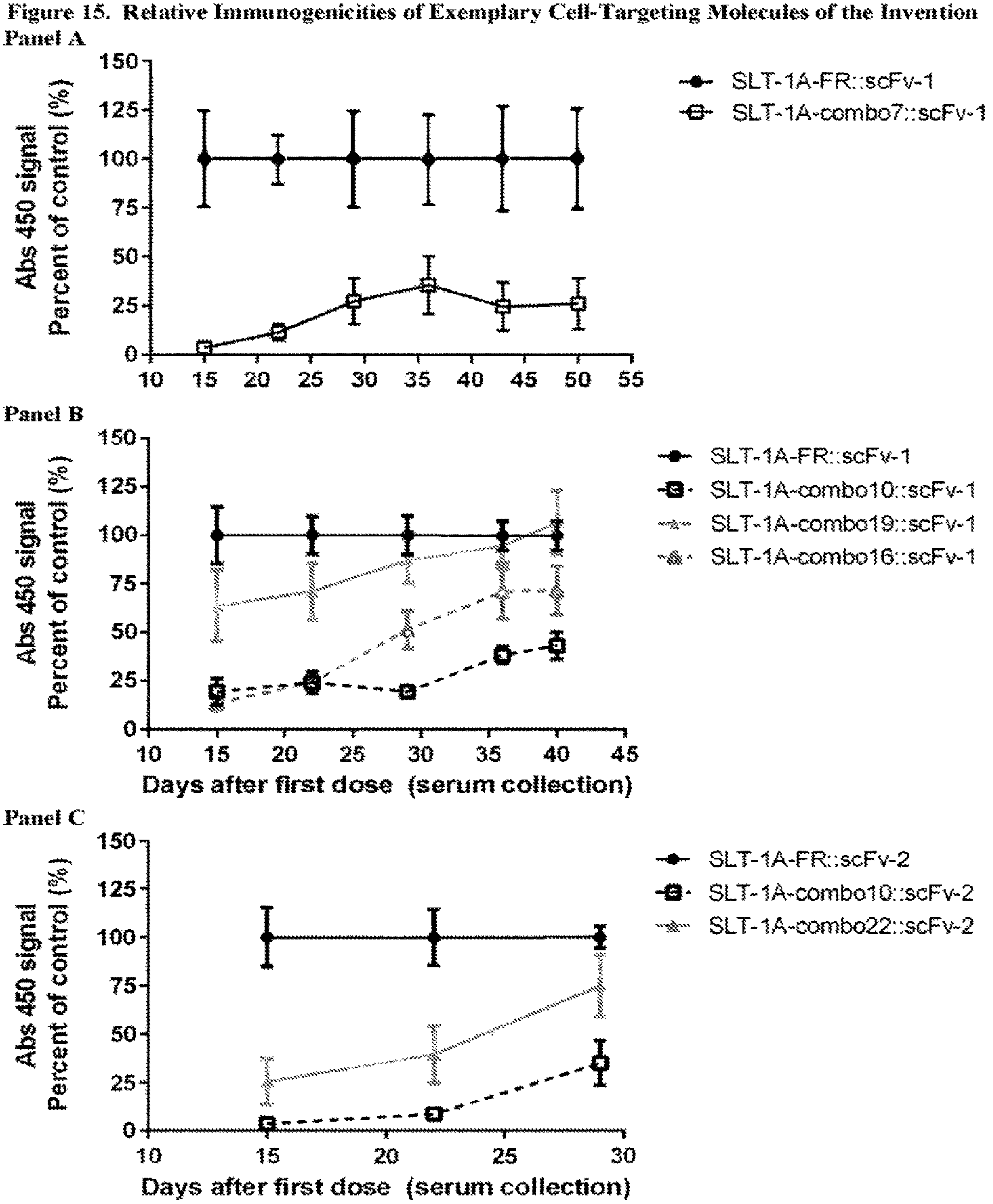
Panel A
- SLT-1A-FR::scFv-1
- SLT-1A-combo7::scFv-1
Panel B
- SLT-1A-FR::scFv-1
- SLT-1A-combo10::scFv-1
- SLT-1A-combo19::scFv-1
- SLT-1A-combo16::scFv-1
Days after first dose (serum collection)
Panel C
- SLT-1A-FR::scFv-2
- SLT-1A-combo10::scFv-2
- SLT-1A-combo22::scFv-2
Days after first dose (serum collection)

Figure 16. Relative Immunogenicities of Exemplary Cell-Targeting Molecules of the Invention
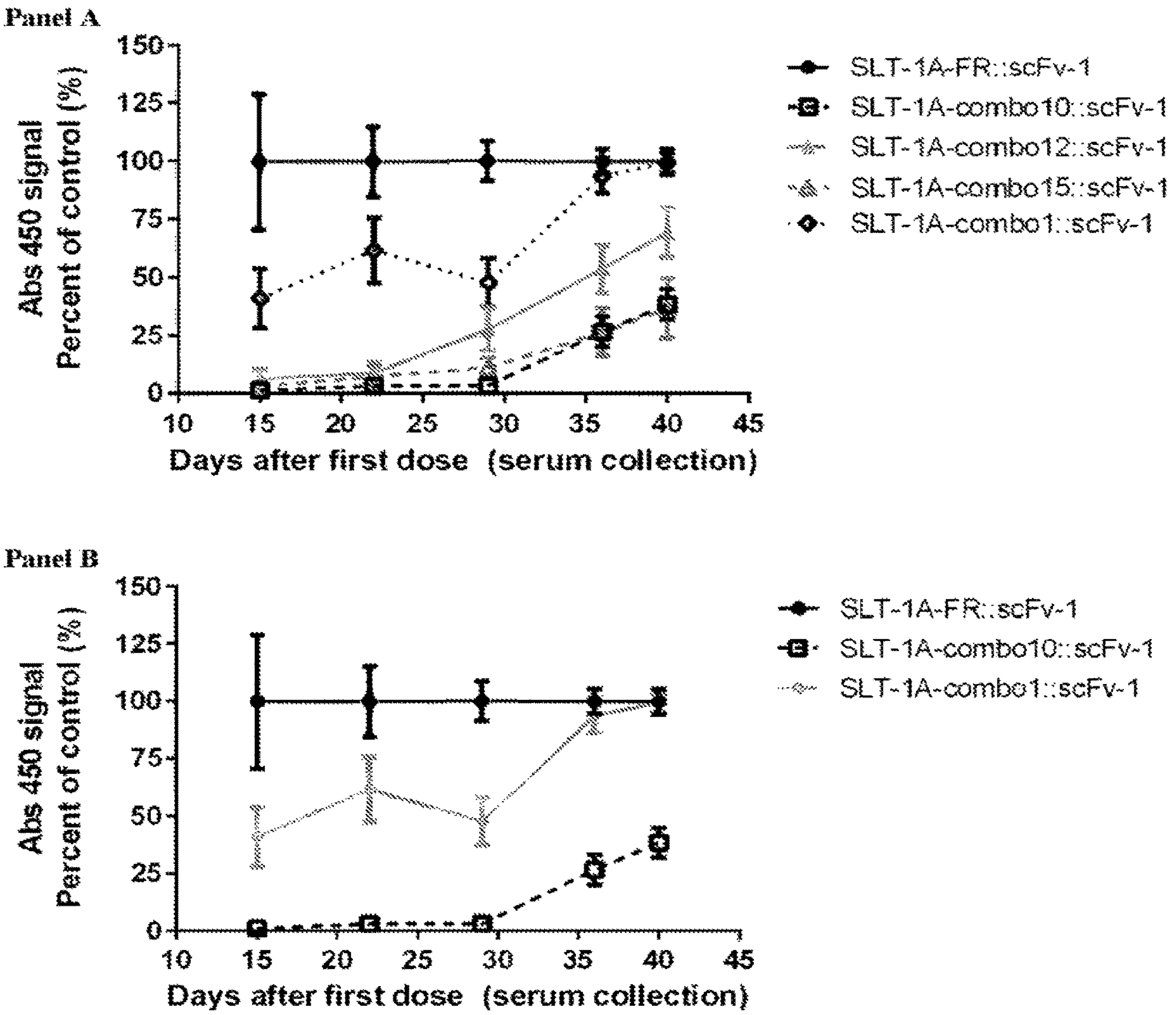
Panel A
- SLT-1A-FR::scFv-1
- SLT-1A-combo10::scFv-1
- SLT-1A-combo12::scFv-1
- SLT-1A-combo15::scFv-1
- SLT-1A-combo1::scFv-1
Panel B
- SLT-1A-FR::scFv-1
- SLT-1A-combo10::scFv-1
- SLT-1A-combo1::scFv-1

Figure 17. *In Vitro* Furin-Cleavage Analysis: Disruption of the Furin-Cleavage Motif at the Carboxy-terminus of the Shiga Toxin A1 Fragment Region Results in Resistance to Proteolytic Cleavage by Human Furin Compared to a Wild-Type Shiga Toxin Effector Polypeptide

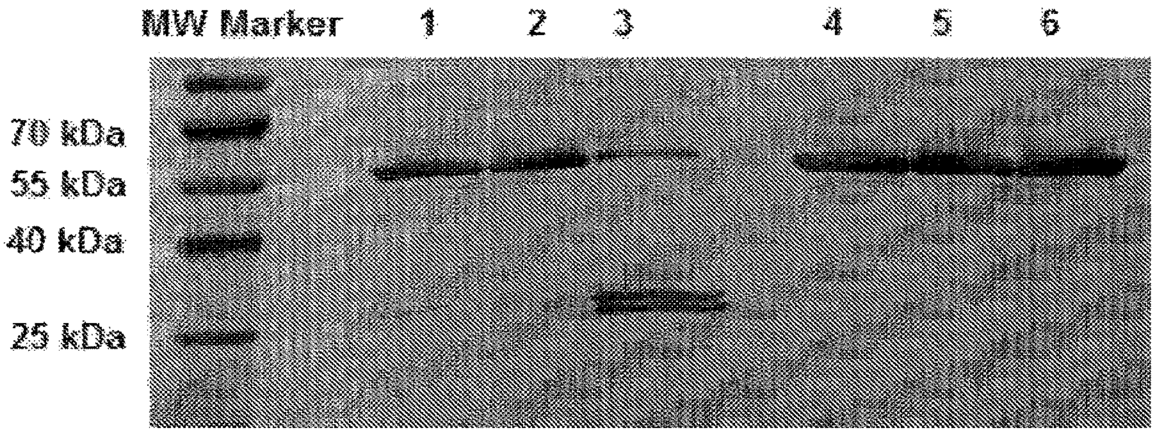

1. SLT-1A-WT::scFv-9 4°C, no furin
2. SLT-1A-WT::scFv-9 30°C, 30 hours, no furin
3. SLT-1A-WT::scFv-9 30°C, 30 hours, 0.5 U/μg furin
4. SLT-1A-FR::scFv-9 4°C, no furin
5. SLT-1A-FR::scFv-9 30°C, 30 hours, no furin
6. SLT-1A-FR::scFv-9 30°C, 30 hours, 0.5 U/μg furin

Figure 18. Cell-Binding Affinities and Specificities of an Exemplary Cell-Targeting Molecule of the Present Invention
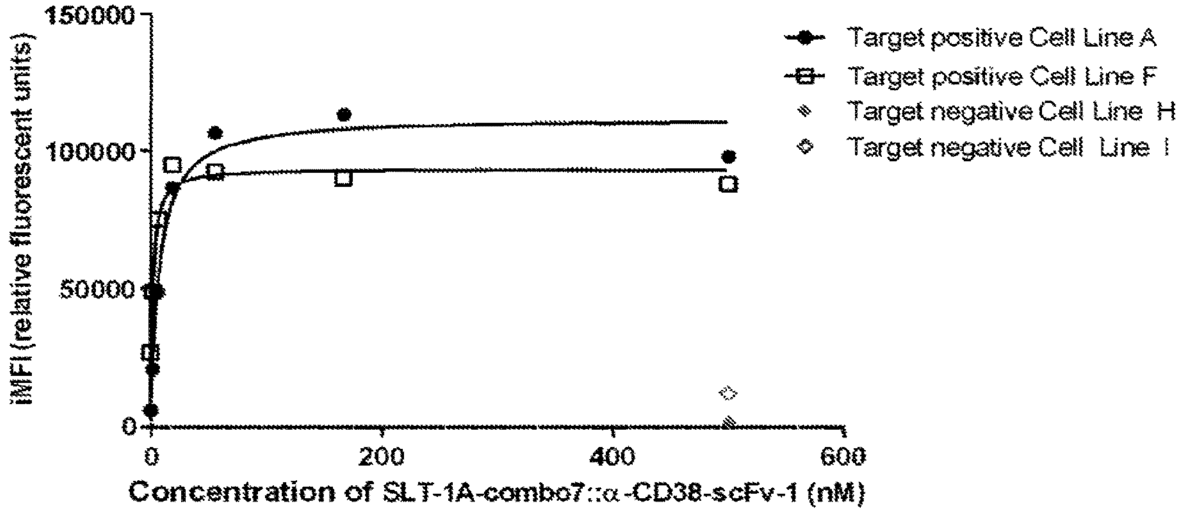
Figure 19. Disseminated Tumor Xenograft Results: SLT-1A-combo7::αCD38-scFv-1 Treatment Reduced Disseminated Tumor Burdens *In Vivo*
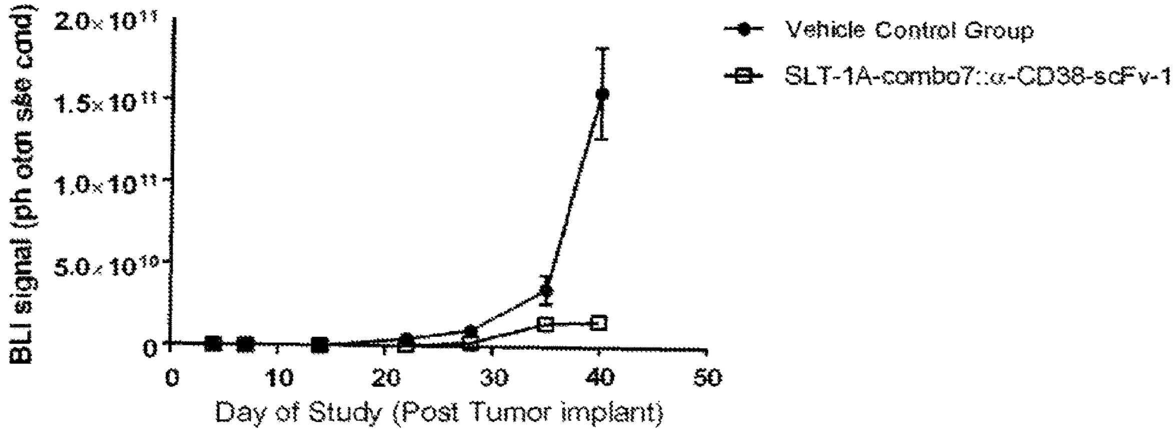

DE-IMMUNIZED, SHIGA TOXIN A SUBUNIT SCAFFOLDS AND CELL-TARGETING MOLECULES COMPRISING THE SAME

CROSS REFERENCE TO RELATED APPLICATIONS

This application is a continuation of U.S. application Ser. No. 15/577,827, filed Nov. 29, 2017 (now abandoned), which is a national stage of International Application No. PCT/US2016/034778, filed on May 27, 2016, which claims priority to U.S. Provisional Application No. 62/168,758, filed on May 30, 2015, U.S. Provisional Application No. 62/168,759, filed on May 30, 2015, U.S. Provisional Application No. 62/168,760, filed on May 30, 2015, U.S. Provisional Application No. 62/168,761, filed on May 30, 2015, U.S. Provisional Application No. 62/168,762, filed on May 30, 2015, and U.S. Provisional Application No. 62/168,763, filed on May 30, 2015 the contents of which are incorporated herein by reference in their entirety for all purposes.

INCORPORATION BY REFERENCE OF SEQUENCE LISTING

The content of the text file submitted electronically herewith is incorporated herein by reference in its entirety: A computer readable format copy of the Sequence Listing (filename: MTEM_008_07US_SeqList_ST25.txt, date created: Apr. 15, 2021, file size: about 939 kilobytes).

TECHNICAL FIELD

The present invention relates to Shiga toxin effector polypeptides, derived from the A Subunits of naturally occurring Shiga toxins, that comprise a combination of mutations providing (1) de-immunization, (2) a reduction in protease sensitivity, and/or (3) an embedded, T-cell epitope(s); wherein the Shiga toxin effector polypeptides retain one or more Shiga toxin functions, such as, e.g., potent cytotoxicity. In certain embodiments, the Shiga toxin effector polypeptides of the present invention (1) exhibit reduced immunogenic potential in mammals and/or (2) are each capable of delivering a CD8+ T-cell epitope to the MHC class I system of a cell in which the polypeptide is present.

The present invention also relates to cell-targeting molecules which comprise a Shiga toxin effector polypeptide of the present invention. The Shiga toxin effector polypeptides of the present invention have uses as scaffolds or components of cell-targeting molecules, such as, e.g., immunotoxins and ligand-toxin fusions, for killing cells and/or subcellular delivery of cargos to certain subcellular compartments, such as, e.g., the delivery of an embedded, T-cell epitope to the cytosol. In general, the Shiga toxin effector polypeptides and cell-targeting molecules of the present invention are useful for administration to multicellular organisms, such as, e.g., when it is desirable to (1) eliminate or reduce non-specific toxicities, (2) eliminate or reduce certain immune responses, and/or (3) target a beneficial immune response(s) to a specific epitope delivered to a specific cell-type, such as, e.g., the recruitment of CD8+ T-cells. The cell-targeting molecules of the present invention are useful (1) for selectively killing specific cell type(s) amongst other cells and (2) as therapeutic molecules for treating a variety of diseases, disorders, and conditions, including cancers, tumors, other growth abnormalities, immune disorders, and microbial infections.

BACKGROUND

The "magic bullet" concept is that therapeutics may be discovered that specifically attack only diseased cells or pathogens within a human patient while leaving the patient unharmed. Immunotoxins, ligand-toxin hybrids, immuno-RNases, and other molecularly targeted drugs are descendants of Dr. Paul Ehrlich's "magic bullet" concept of the early 20$^{th}$ century (Strebhardt K, Ullrich A, *Nat Rev Cancer* 8: 473-80 (2008)). The toxin produced by *S. dysenteriae* was named "Shiga toxin" after Dr. Ehrlich's associate Dr. Kiyoshi Shiga for his discovery of this bacterium in 1897. Recently, Shiga toxins have become appreciated for having unique characteristics favorable for use in cell-internalizing molecules for targeted therapies (see e.g. US20150259428). Shiga toxins may be combined with immunoglobulin domains, ligands, and other targeting moieties to create cell-targeted therapeutics (e.g., immunotoxins and ligand-toxin fusions) that are "magic bullets."

Shiga toxins may have advantageous properties for use in therapeutics, such as, e.g., a potent toxin mechanism effective toward eukaryotic cells, ability to drive cellular internalization, and ability to direct subcellular routing. Shiga toxins have been synthetically engineered for medical applications by rational alterations to the toxin's structure, characteristics, and biological activities (see, e.g. WO 1999/040185, WO 2005/092917, EP1051482, DE69835695, WO 2007/033497, US2009/0156417, JP4339511, U.S. Pat. No. 7,713,915, EP1727827, DE602004027168, EP1945660, JP4934761, EP2228383, US2013/0196928, WO 2014/164680, WO 2014/164693, US20150259428, WO 2015/138435, WO 2015/138452, WO 2015/113005, WO 2015/113007, and WO 2015/191764, each of which is incorporated by reference herein in its entirety). Shiga toxin A Subunits are stable, enzymatically active, and cytotoxic even if truncated or fused to other protein domains.

Major limitations to therapeutic applications involving synthetically engineered molecules derived from bacterial toxins include both detrimental immunogenic responses in recipients and non-specific toxicities caused by toxic components. Unwanted immunogenicity of a therapeutic product could result in unfavorable consequences, such as a reduced efficacy, the production of neutralizing antibodies, altered pharmacokinetics, general immune and hypersensitivity reactions, anaphylaxis, anaphylactoid reactions, and constraints on the number of repeat doses a recipient can safely receive. Reducing the non-specific toxicity of a therapeutic molecule can improve its safety characteristics when administered to a recipient as well as alter its potential therapeutic window by increasing the maximum dosage which can be administered safely. Because both unwanted immune responses and non-specific toxicities can pose significant safety and/or efficacy issue(s) for *a drug* therapy, reducing or minimizing the probabilities of both is often desirable when developing therapeutic molecules.

The stability of a therapeutic or diagnostic molecule over time and in specific environments (e.g. the human circulatory system) are important features and can affect for which applications a molecule may be practically employed. For certain immunotoxins or ligand-toxin fusions, the stability of the linkage between the toxin and other components can affect the amount of non-specific toxicity caused by the release of untargeted toxin over time within the body of a multicellular organism. Thus, for molecules comprising toxin components, certain non-specific toxicities are directly related to the stability of the connection between the toxin component and another component, such as, e.g., a cell-targeting component.

Shiga toxins can be combined with heterologous epitopes to create cell-targeted therapeutics which deliver chosen epitope cargos for the purpose of inducing desirable immune responses (see WO 2015/113007). These immune responses may be harnessed by therapeutic molecules for the targeted killing of specific cell-types within a patient as well as to sensitize the patient's immune system to identifying certain cells as foreign (i.e. breaking immunotolerance). For example, the Major Histo-Compatibility (MHC) class I presentation pathway may be exploited by such approaches to induce the recruitment of immune cells to tumor loci within a patient and to enhance the recognition of certain neoplastic cells by immune surveillance mechanisms.

It would be desirable to have Shiga toxin A Subunit-derived polypeptides with low antigenicity, low immunogenicity, and/or comprising heterologous epitopes, but which retain a significant level of a Shiga toxin function(s), such as, e.g., potent cytotoxicity, the ability to force cellular internalization, and/or the ability to efficiently route to a desired intracellular location(s). Furthermore, it would be desirable to have therapeutic and/or diagnostic molecules comprising Shiga toxin A Subunit derived components having low antigenicity, low immunogenicity, high stability, low non-specific toxicity, and/or the ability to deliver peptide-epitope cargos for presentation by the MHC class I system of a target cell. In particular, it would be desirable to have cell-targeting molecules comprising Shiga toxin A Subunit derived components that maintain potent cytotoxicity while 1) reducing the potential for unwanted antigenicities and/or immunogenicities, 2) reducing the potential for non-specific toxicities, and/or 3) having the ability to deliver peptide-epitope cargos for presentation by the MHC class I system of a target cell.

SUMMARY OF THE INVENTION

The Shiga toxin A Subunit derived scaffolds of the present invention each comprise a combination of features (e.g., de-immunized sub-region(s), heterologous epitope comprising sub-region(s), a protease-cleavage resistant sub-region, and/or a carboxy-terminal, endoplasmic reticulum retention/retrieval signal motif) which make them more useful, such as, e.g., as components of cell-targeting molecules like immunotoxins and ligand-toxin fusions. Certain combination Shiga toxin effector polypeptides of the present invention are more useful because they provide several Shiga toxin effector functions in a single polypeptide, such as, e.g., promoting cellular internalization, directing sub-cellular routing to the cytosol, ribosome inactivation, and/or delivering heterologous, T-cell epitopes to the MHC I class pathway of a cell. Certain cell-targeting molecules of the present invention are more useful because they provide a combination of several properties in a single molecule, such as, e.g., efficient cellular internalization, potent cell-targeted cytotoxicity, selective cytotoxicity, de-immunization, low non-specific toxicity at high dosages, high stability, CD+ T-cell hyper-immunization, and/or the ability to deliver a heterologous, T-cell epitope(s) to the MHC I class pathway of a target cell.

Different embodiments of the Shiga toxin effector polypeptides and cell-targeting molecules of the present invention are described below with reference to sets of embodiments numbered #1-11.

Embodiment Set #1—De-Immunized, Shiga Toxin Effector Polypeptide Comprising an Embedded or Inserted, Heterologous, T-Cell Epitope The present invention provides a de-immunized, Shiga toxin effector polypeptide comprising at least one inserted or embedded, heterologous epitope (a) and at least one disrupted, endogenous, B-cell and/or CD4+ T-cell epitope region (b), wherein the heterologous epitope does not overlap with at least one disrupted, endogenous, B-cell and/or CD4+ T-cell epitope region; and wherein the Shiga toxin effector polypeptide is capable of exhibiting at least one Shiga toxin effector function (see e.g. FIG. 1, depicting illustrative examples of three, exemplary embodiments of the de-immunized Shiga toxin effector polypeptide of this embodiment set #1 labeled Shiga toxin effector 1, 2, and 3). In certain further embodiments, the heterologous epitope is a CD8+ T-cell epitope capable of being presented by a MHC class I molecule of a cell. In certain further embodiments, the heterologous epitope in (a) is embedded and replaces an equivalent number of amino acid residues in a wild-type Shiga toxin polypeptide region such that the Shiga toxin effector polypeptide has the same total number of amino acid residues as does the wild-type Shiga toxin polypeptide region from which it is derived. In certain further embodiments of any of the above, the de-immunized, Shiga toxin effector polypeptide is capable of exhibiting at least one Shiga toxin effector function selected from: directing intracellular routing to a cytosol of a cell in which the polypeptide is present, inhibiting a ribosome function, enzymatically inactivating a ribosome, and cytotoxicity.

In certain embodiments, the de-immunized, Shiga toxin effector polypeptide of the present invention comprises (i) an embedded or inserted, heterologous, T-cell epitope and (ii) a disruption of at least one, endogenous, B-cell and/or T-cell epitope which does not overlap with the embedded or inserted, heterologous, T-cell epitope. In certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous, T-cell epitope is a CD8+ T-cell epitope, such as, e.g., with regard to a human immune system. In certain further embodiments, the heterologous, T-cell epitope is capable of being presented by a MHC class I molecule of a cell. In certain further embodiments, the endogenous, T-cell epitope is a CD4+ T-cell epitope, such as, e.g., with regard to a human immune system.

In certain embodiments, the de-immunized, Shiga toxin effector polypeptide of the present invention comprises (i) an embedded or inserted, heterologous, T-cell epitope and (ii) a disruption of at least one, endogenous, B-cell and/or T-cell epitope region which does not overlap with the embedded or inserted, heterologous, T-cell epitope. In certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous, T-cell epitope is a CD8+ T-cell epitope, such as, e.g., with regard to a human immune system. In certain further embodiments, the heterologous, T-cell epitope is capable of being presented by a MHC class I molecule of a cell. In certain further embodiments, the endogenous, T-cell epitope region is a CD4+ T-cell epitope region, such as, e.g., with regard to a human immune system.

In certain embodiments, the de-immunized, Shiga toxin effector polypeptide of the present invention comprises (i) an embedded or inserted, heterologous, T-cell epitope and (ii) a disruption of at least one, endogenous, B-cell and/or T-cell epitope which does not overlap with the embedded or inserted, heterologous, T-cell epitope. In certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous, T-cell epitope is a CD8+ T-cell epitope, such as, e.g., with regard to a human immune system. In certain further embodiments, the heterologous, T-cell epitope is capable of being presented by a MHC class I molecule of a cell. In certain further embodiments, the endogenous, T-cell epitope is a CD4+ T-cell epitope, such as, e.g., with regard to a human immune system.

In certain embodiments, the de-immunized, Shiga toxin effector polypeptide of the present invention comprises (i) an embedded or inserted, heterologous, T-cell epitope and (ii) a disruption of at least one, endogenous, B-cell and/or T-cell epitope region which does not overlap with the embedded or inserted, heterologous, T-cell epitope. In certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous, T-cell epitope is a CD8+ T-cell epitope, such as, e.g., with regard to a human immune system. In certain further embodiments, the heterologous, T-cell epitope is capable of being presented by a MHC class I molecule of a cell. In certain further embodiments, the endogenous, T-cell epitope region is a CD4+ T-cell epitope region, such as, e.g., with regard to a human immune system.

In certain embodiments of Embodiment Set #1, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of: 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2, and 210-218 of SEQ ID NO:3; 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; 285-293 of SEQ ID NO:1 or SEQ ID NO:2; 4-33 of SEQ ID NO:1 or SEQ ID NO:2; 34-78 of SEQ ID NO:1 or SEQ ID NO:2; 77-103 of SEQ ID NO:1 or SEQ ID NO:2; 128-168 of SEQ ID NO:1 or SEQ ID NO:2; 160-183 of SEQ ID NO:1 or SEQ ID NO:2; 236-258 of SEQ ID NO:1 or SEQ ID NO:2; and 274-293 of SEQ ID NO:1 or SEQ ID NO:2; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments of Embodiment Set #1, the Shiga toxin effector polypeptide comprises a mutation, relative to a wild-type Shiga toxin A Subunit, in the B-cell immunogenic, amino acid residue selected from the group of natively positioned Shiga toxin A Subunit amino acid residues: L49, D197, D198, R204, and R205.

In certain embodiments of Embodiment Set #1, the embedded or inserted, heterologous, T-cell epitope disrupts the endogenous, B-cell and/or T-cell epitope region is selected from the group of natively positioned Shiga toxin A Subunit regions consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3; or the equivalent region in a Shiga toxin A Subunit or derivative thereof, wherein there is no disruption which is an amino-terminal truncation of sequences that overlap with part or all of at least one disrupted epitope region; (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; or the equivalent region in a Shiga toxin A Subunit or derivative thereof.

In certain embodiments of Embodiment Set #1, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3; or the equivalent region in a Shiga toxin A Subunit or derivative thereof, wherein there is no disruption which is an amino-terminal truncation of sequences that overlap with part or all of at least one disrupted epitope region; (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; or the equivalent region in a Shiga toxin A Subunit or derivative thereof, wherein there is no disruption which is an amino-terminal truncation of sequences that overlap with part or all of at least one disrupted epitope region.

In certain embodiments of Embodiment Set #1, the Shiga toxin effector polypeptide comprises a disruption of at least one endogenous epitope region selected from the group of natively positioned Shiga toxin A Subunits consisting of: 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; or 210-218 of SEQ ID NO:3.

In certain embodiments of Embodiment Set #1, the Shiga toxin effector polypeptide does not comprise a heterologous, MHC class I-restricted, T-cell epitope. MHC class I-restricted, T-cell epitopes are known in the art or can be predicted by the skilled worker. The term heterologous refers to MHC class I-restricted, T-cell epitopes which are not natively present in wild-type Shiga toxin A Subunits, such as, e.g., the wild-type Shiga toxin A Subunit which is most closely related to the Shiga toxin effector polypeptide of interest.

In certain embodiments of Embodiment Set #1, the Shiga toxin effector polypeptide comprises disruptions of at least two, three, four, five, six, seven, eight, or more endogenous, B-cell and/or T-cell epitope regions.

In certain embodiments of Embodiment Set #1, one or more disruptions comprises an amino acid residue substitution relative to a wild-type Shiga toxin A Subunit.

In certain embodiments of Embodiment Set #1, one or more endogenous, B-cell and/or T-cell epitope regions comprises a plurality of amino acid residue substitutions relative to a wild-type Shiga toxin A Subunit.

In certain embodiments of Embodiment Set #1, at least one, two, three, or four disruptions comprise a plurality of amino acid residue substitutions in the endogenous, B-cell and/or T-cell epitope region relative to a wild-type Shiga toxin A Subunit.

In certain embodiments of Embodiment Set #1, at least one disruption comprises at least one, two, three, four, five, six, seven, eight, or more amino acid residue substitutions relative to a wild-type Shiga toxin A Subunit, and optionally wherein at least one substitution occurs at the natively positioned Shiga toxin A Subunit amino acid residue selected form the group consisting of: 1 of SEQ ID NO:1 or SEQ ID NO:2; 4 of SEQ ID NO:1, SEQ ID NO:2, or SEQ ID NO:3; 6 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 12 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 44 of SEQ ID NO:1 or SEQ ID NO:2; 45 of SEQ ID NO:1 or SEQ ID NO:2; 46 of SEQ ID NO:1, SEQ ID NO:2, or SEQ ID NO:3; 47 of SEQ ID NO:1 or SEQ ID NO:2; 48 of SEQ ID NO:1, SEQ ID NO:2, or SEQ ID NO:3; 49 of SEQ ID NO:1, SEQ ID NO:2, or SEQ ID NO:3; 50 of SEQ ID NO:1 or SEQ ID NO:2; 51 of SEQ ID NO:1 or SEQ ID NO:2; 53 of SEQ ID NO:1 or SEQ ID NO:2; 54 of SEQ ID NO:1, SEQ ID NO:2, or SEQ ID NO:3; 55 of SEQ ID NO:1 or SEQ ID NO:2; 56 of SEQ ID NO:1, SEQ ID NO:2, or SEQ ID NO:3; 57 of SEQ ID NO:1, SEQ ID NO:2, or SEQ ID NO:3; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 84 of SEQ ID NO:1 or SEQ ID NO:2; 88 of SEQ ID NO:1, SEQ ID NO:2, or SEQ ID NO:3; 94 of SEQ ID NO:1, SEQ ID NO:2, or SEQ ID NO:3; 96 of SEQ ID NO:1, SEQ ID NO:2, or SEQ ID NO:3; 104 of SEQ ID NO:1 or SEQ ID NO:2; 105 of SEQ ID NO:1 or SEQ ID NO:2; 107 of SEQ ID NO:1, SEQ ID NO:2, or SEQ ID NO:3; 108 of SEQ ID NO:1 or SEQ ID NO:2; 109 of SEQ ID NO:1, SEQ ID NO:2, or SEQ ID NO:3; 110 of SEQ ID NO:1 or SEQ ID NO:2; 111 of SEQ ID NO:1, SEQ ID NO:2, or SEQ ID NO:3; 112 of SEQ ID NO:1, SEQ ID NO:2, or SEQ ID NO:3; 141 of SEQ ID NO:1, SEQ ID NO:2, or SEQ ID NO:3; 147 of SEQ ID NO:1, SEQ ID NO:2, or SEQ ID NO:3; 154 of SEQ ID NO:1 or SEQ ID NO:2; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 197 of SEQ ID NO:3; 198 of SEQ ID NO:1 or SEQ ID NO:2; 204 of SEQ ID NO:3; 205 of SEQ ID NO:1 or SEQ ID NO:2; 247 of SEQ ID NO:1 or SEQ ID NO:2; 247 of SEQ ID NO:3; 248 of SEQ ID NO:1 or SEQ ID NO:2; 250 of SEQ ID NO:3; 251 of SEQ ID NO:1 or SEQ ID NO:2; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2; or the equivalent amino acid residue in a Shiga toxin A Subunit or derivative thereof. In certain further embodiments, at least two disruptions each comprise at least one amino acid residue substitutions relative to a wild-type Shiga toxin A Subunit selected form the group consisting of: 1 of SEQ ID NO:1 or SEQ ID NO:2; 4 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 45 of SEQ ID NO:1 or SEQ ID NO:2; 47 of SEQ ID NO:1 or SEQ ID NO:2; 48 of SEQ ID NO:1, SEQ ID NO:2, or SEQ ID NO:3; 49 of SEQ ID NO:1 or SEQ ID NO:2; 53 of SEQ ID NO:1 or SEQ ID NO:2; 55 of SEQ ID NO:1 or SEQ ID NO:2; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 94 of SEQ ID NO:1, SEQ ID NO:2, or SEQ ID NO:3; 96 of SEQ ID NO:1, SEQ ID NO:2, or SEQ ID NO:3; 109 of SEQ ID NO:1, SEQ ID NO:2, or SEQ ID NO:3; 110 of SEQ ID NO:1 or SEQ ID NO:2; 112 of SEQ ID NO:1, SEQ ID NO:2, or SEQ ID NO:3; 147 of SEQ ID NO:1, SEQ ID NO:2, or SEQ ID NO:3; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 204 of SEQ ID NO:3; 205 of SEQ ID NO:1 or SEQ ID NO:2; 247 of SEQ ID NO:1 or SEQ ID NO:2; 247 of SEQ ID NO:3; 250 of SEQ ID NO:3; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2; or the equivalent amino acid residue in a Shiga toxin A Subunit or derivative thereof.

In certain embodiments of Embodiment Set #1, the Shiga toxin effector polypeptide comprises disruption of at least three, endogenous, B-cell and/or T-cell epitope regions selected from the group of consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3, or the equivalent region in a Shiga toxin A Subunit or derivative thereof, wherein there is no disruption which is an amino-terminal truncation of amino acid residues that overlap with part or all of at least one disrupted, endogenous, B-cell and/or T-cell epitope region; (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; or the equivalent region in a Shiga toxin A Subunit or derivative thereof, wherein there is no disruption which is a carboxy-terminal truncation of amino acid residues that overlap with part or all of at least one disrupted, endogenous, B-cell and/or T-cell epitope and/or epitope region.

In certain embodiments of Embodiment Set #1, the Shiga toxin effector polypeptide comprises disruptions of at least two, endogenous, B-cell and/or T-cell epitope regions, wherein each disruption comprises one or more amino acid residue substitutions, and wherein the endogenous, B-cell and/or T-cell epitope regions are selected from the group of natively positioned Shiga toxin A Subunit regions consisting of: 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; or the equivalent region in a Shiga toxin A Subunit or derivative thereof.

In certain embodiments of Embodiment Set #1, the embedded or inserted, heterologous, T-cell epitope does not disrupt any endogenous, B-cell and/or CD4+ T-cell epitope region described herein.

In certain embodiments of Embodiment Set #1, at least one disruption comprises one or more amino acid residue substitutions relative to a wild-type Shiga toxin A Subunit is selected from the group consisting of: D to A, D to G, D to V, D to L, D to I, D to F, D to S, D to Q, D to M, D to R, E to A, E to G, E to V, E to L, E to I, E to F, E to S, E to Q, E to N, E to D, E to M, E to R, F to A, F to G, F to V, F to L, F to I, G to A, G to P, H to A, H to G, H to V, H to L, H to I, H to F, H to M, I to A, I to V, I to G, I to C, K to A, K to G, K to V, K to L, K to I, K to M, K to H, L to A, L to V, L to G, L to C, N to A, N to G, N to V, N to L, N to I, N to F, P to A, P to G, P to F, R to A, R to G, R to V, R to L, R to I, R to F, R to M, R to Q, R to S, R to K, R to H, S to A, S to G, S to V, S to L, S to I, S to F, S to M, T to A, T to G, T to V, T to L, T to I, T to F, T to M, T to S, V to A, V to G, Y to A, Y to G, Y to V, Y to L, Y to I, Y to F, Y to M, and Y to T. In certain further embodiments, the one or more amino acid residue substitutions relative to a wild-type Shiga toxin A Subunit is selected from the group consisting of: D to A, D to G, D to V, D to L, D to I, D to F, D to S, D to Q, E to A, E to G, E to V, E to L, E to I, E to F, E to S, E to Q, E to N, E to D, E to M, E to R, G to A, H to A, H to G, H to V, H to L, H to I, H to F, H to M, K to A, K to G, K to V, K to L, K to I, K to M, K to H, L to A, L to G, N to A, N to G, N to V, N to L, N to I, N to F, P to A, P to G, P to F, R to A, R to G, R to V, R to L, R to I, R to F, R to M, R to Q, R to S, R to K, R to H, S to A, S to G, S to V, S to L, S to I, S to F, S to M, T to A, T to G, T to V, T to L, T to I, T to F, T to M, T to S, Y to A, Y to G, Y to V, Y to L, Y to I, Y to F, and Y to M.

In certain embodiments of Embodiment Set #1, at least one of the disruption(s) comprises one or more amino acid residue substitutions relative to a wild-type Shiga toxin A Subunit selected from the group consisting of: K1 to A, G, V, L, I, F, M and H; T4 to A, G, V, L, I, F, M, and S; D6 to A, G, V, L, I, F, S, Q and R; S8 to A, G, V, I, L, F, and M; T9 to A, G, V, I, L, F, M, and S; S9 to A, G, V, L, I, F, and M; K11 to A, G, V, L, I, F, M and H; T12 to A, G, V, I, L, F, M, S, and K; S12 to A, G, V, I, L, F, and M; S33 to A, G, V, L, I, F, M, and C; S43 to A, G, V, L, I, F, and M; G44 to A or L; S45 to A, G, V, L, I, F, and M; T45 to A, G, V, L, I, F, and M; G46 to A and P; D47 to A, G, V, L, I, F, S, M, and Q; N48 to A, G, V, L, M and F; L49 to A, V, C, and G; Y49 to A, G, V, L, I, F, M, and T; F50 to A, G, V, L, I, and T; A51; D53 to A, G, V, L, I, F, S, and Q; V54 to A, G, I, and L; R55 to A, G, V, L, I, F, M, Q, S, K, and H; G56 to A and P; 157 to A, G, V, and M; L57 to A, V, C, G, M, and F; D58 to A, G, V, L, I, F, S, and Q; P59 to A, G, and F; E60 to A, G, V, L, I, F, S, Q, N, D, M, T, and R; E61 to A, G, V, L, I, F, S, Q, N, D, M, and R; G62 to A; R84 to A, G, V, L, I, F, M, Q, S, K, and H; V88 to A and G; 188 to A, V, C, and G; D94 to A, G, V, L, I, F, S, and Q; S96 to A, G, V, I, L, F, and M; T104 to A, G, V, L, I, F, M; and N; A105 to L; T107 to A, G, V, L, I, F, M, and P; S107 to A, G, V, L, I, F, M, and P; L108 to A, V, C, and G; S109 to A, G, V, I, L, F, and M; T109 to A, G, V, I, L, F, M, and S; G110 to A; S112 to A, G, V, L, I, F, and M; D111 to A, G, V, L, I, F, S, Q, and T; S112 to A, G, V, L, I, F, and M; D141 to A, G, V, L, I, F, S, and Q; G147 to A; V154 to A and G. R179 to A, G, V, L, I, F, M, Q, S, K, and H; T180 to A, G, V, L, I, F, M, and S; T181 to A, G, V, L, I, F, M, and S; D183 to A, G, V, L, I, F, S, and Q; D184 to A, G, V, L, I, F, S, and Q; L185 to A, G, V and C; S186 to A, G, V, I, L, F, and M; G187 to A; R188 to A, G, V, L, I, F, M, Q, S, K, and H; S189 to A, G, V, I, L, F, and M; D197 to A, G, V, L, I, F, S, and Q; D198 to A, G, V, L, I, F, S, and Q; R204 to A, G, V, L, I, F, M, Q, S, K, and H; R205 to A, G, V, L, I, F, M, Q, S, K and H; S247 to A, G, V, I, L, F, and M; Y247 to A, G, V, L, I, F, and M; R248 to A, G, V, L, I, F, M, Q, S, K, and H; R250 to A, G, V, L, I, F, M, Q, S, K, and H; R251 to A, G, V, L, I, F, M, Q, S, K, and H; D264 to A, G, V, L, I, F, S, and Q; G264 to A; and T286 to A, G, V, L, I, F, M, and S.

In certain embodiments of Embodiment Set #1, the Shiga toxin effector polypeptide consists essentially of the polypeptide shown in any one of SEQ ID NOs: 355-369 which further comprises a disruption of at least one, endogenous, B-cell and/or T-cell epitope region which does not overlap with an embedded or inserted, heterologous, CD8+ T-cell epitope.

In certain embodiments of Embodiment Set #1, the Shiga toxin effector polypeptide comprises or consists essentially of the polypeptide shown in any one of SEQ ID NOs: 6-32, 340-354, and 370-438.

For certain embodiments of Embodiment Set #1, the Shiga toxin effector polypeptide is capable of exhibiting (i) a catalytic activity level comparable to a wild-type Shiga toxin A1 fragment or wild-type Shiga toxin effector polypeptide, (ii) a ribosome inhibition activity with an half-maximal inhibitory concentration ($IC_{50}$) value of 10,000 picomolar or less, and/or (iii) a significant level of Shiga toxin catalytic activity.

For certain embodiments of Embodiment Set #1, the Shiga toxin effector polypeptide is capable of exhibiting subcellular routing efficiency comparable to a wild-type Shiga toxin effector polypeptide and/or capable of exhibiting a significant level of intracellular routing activity to the endoplasmic reticulum and/or cytosol from an endosomal starting location of a cell.

For certain embodiments of Embodiment Set #1, the Shiga toxin effector polypeptide is capable of intracellular delivery of the embedded or inserted, heterologous, T-cell epitope from an early endosomal compartment to a MHC class I molecule of a cell in which the Shiga toxin effector polypeptide is present. For certain further embodiments, the Shiga toxin effector polypeptide is capable of exhibiting one or more Shiga toxin effector functions in addition to the intracellular delivery, such as, e.g., the Shiga toxin effector functions of: promoting cellular internalization, directing sub-cellular routing to the cytosol, ribosome inactivation, inducing caspase activity, causing cytostasis, and/or causing cell death. In certain further embodiments, the heterologous, T-cell epitope is a CD8+ T-cell epitope, such as, e.g., with regard to a human immune system.

In certain embodiments of Embodiment Set #1, the Shiga toxin effector polypeptide comprises a disruption of at least two, endogenous, epitope regions selected the group of natively positioned Shiga toxin A Subunit regions consisting of: 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; or 210-218 of SEQ ID NO:3; wherein the disruption does not consist solely of the amino acid residue substitution selected from the group consisting of: S96Y of SEQ ID NO:1 or SEQ ID NO:2; Y114S of SEQ ID NO:1 or SEQ ID NO:2; R179A of SEQ ID NO:1 or SEQ ID NO:2; R179H of SEQ ID NO:1 or SEQ ID NO:2; L185A of SEQ ID NO:1 or SEQ ID NO:2; R188A of SEQ ID NO:1 or SEQ ID NO:2; R205A of SEQ ID NO:1 or SEQ ID NO:2; R179A/R188A of SEQ ID NO:1; or SEQ ID NO:2; or A188V of SEQ ID NO:3.

In certain embodiments of Embodiment Set #1, the Shiga toxin effector polypeptide comprises a disruption comprising a mutation of at least one amino acid residue in at least one, endogenous epitope region selected from the group of natively positioned Shiga toxin A Subunit regions consisting of: 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; wherein the Shiga toxin effector polypeptide comprises no amino-terminus truncation overlapping with the aforementioned disrupted epitope region.

In certain embodiments of Embodiment Set #1, the Shiga toxin effector polypeptide comprises a disruption comprising a mutation of at least one amino acid residue in at least two, endogenous epitope regions selected from the group of natively positioned Shiga toxin A Subunit regions consisting of: 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; wherein the disruption does not consist solely of the amino acid residue substitution R63W of SEQ ID NO:1 or SEQ ID NO:2; and wherein the Shiga toxin effector region comprises no amino-terminus truncation overlapping with the aforementioned, two, disrupted epitope regions.

In certain embodiments of Embodiment Set #1, the Shiga toxin effector polypeptide comprises a disruption comprising a mutation of at least one amino acid residue in at least one, endogenous epitope region selected from the group of natively positioned Shiga toxin A Subunit regions consisting of: 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; wherein the Shiga toxin effector polypeptide comprises no carboxy-terminus truncation overlapping with the aforementioned disrupted epitope region.

In certain embodiments of Embodiment Set #1, the Shiga toxin effector polypeptide comprises a disruption comprising a mutation of at least one amino acid residue in at least two, endogenous epitope regions selected from the group of natively positioned Shiga toxin A Subunit regions consisting of: 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; wherein the Shiga toxin effector polypeptide does not comprise the mutation selected from the group consisting of: R248H of SEQ ID NO:1 or SEQ ID NO:2; A250V of SEQ ID NO:1 or SEQ ID NO:2; R251H of SEQ ID NO:1 or SEQ ID NO:2; A253G of SEQ ID NO:1 or SEQ ID NO:2; S254T of SEQ ID NO:1 or SEQ ID NO:2; C261A of SEQ ID NO:1 or SEQ ID NO:2; R289K of SEQ ID NO:1 or SEQ ID NO:2; R248H and R251H of SEQ ID NO:1 or SEQ ID NO:2; A253G and S254T of SEQ ID NO:1 or SEQ ID NO:2; the deletion of 5247-M252 of SEQ ID NO:1; S246F of SEQ ID NO:3; A282V of SEQ ID NO:3; 1291V of SEQ ID NO:3; S246F of SEQ ID NO:3; and wherein the Shiga toxin effector polypeptide comprises no carboxy-terminus truncation overlapping with the aforementioned, two, disrupted epitope regions.

In certain embodiments of Embodiment Set #1, the de-immunized, Shiga toxin effector polypeptide comprises or consists essentially of the polypeptide shown in any one of SEQ ID NOs: 6-27, 29-32, 340-354, and 370-438.

In certain embodiments of Embodiment Set #1, the Shiga toxin effector polypeptide of the present invention comprises one or more mutations relative to a naturally occurring A Subunit of a member of the Shiga toxin family which changes an enzymatic activity of the Shiga toxin effector polypeptide, the mutation selected from at least one amino acid residue deletion, insertion, or substitution. In certain further embodiments, the mutation relative to the naturally occurring A Subunit reduces of eliminates a cytotoxic activity of the Shiga toxin effector polypeptide but the Shiga toxin effector polypeptide retains at least one other Shiga toxin effector function, such as, e.g., promoting cellular internalization and/or directing intracellular routing to a certain subcellular compartment(s). In certain further embodiments, the mutation relative to the naturally occurring A Subunit is selected from at least one amino acid residue substitution, such as, e.g., A231E, R75A, Y77S, Y114S, E167D, R170A, R176K, and/or W203A in SEQ ID NO:1, SEQ ID NO:2, or SEQ ID NO:3.

In certain embodiments of Embodiment Set #1, the Shiga toxin effector polypeptide comprises (i) a Shiga toxin A1 fragment derived region having a carboxy terminus and (ii) a disrupted furin-cleavage motif at the carboxy-terminus of the A1 fragment region. In certain further embodiments, the disrupted furin-cleavage motif comprises one or more mutations, relative to a wild-type Shiga toxin A Subunit, the mutation altering at least one amino acid residue in a region natively positioned at 248-251 of the A Subunit of Shiga-like toxin 1 (SEQ ID NO:1) or Shiga toxin (SEQ ID NO:2), or at 247-250 of the A Subunit of Shiga-like toxin (SEQ ID NO:3); or the equivalent region in a Shiga toxin A Subunit or derivative thereof. In certain further embodiments, the disrupted furin-cleavage motif comprises one or more mutations, relative to a wild-type Shiga toxin A Subunit, in a minimal furin cleavage site of the furin-cleavage motif. In certain further embodiments the minimal furin cleavage site is represented by the consensus amino acid sequence R/Y-x-x-R and/or R-x-x-R.

In certain embodiments of Embodiment Set #1, the Shiga toxin effector polypeptide comprises (i) a Shiga toxin A1 fragment derived region having a carboxy terminus and (ii) a disrupted furin-cleavage motif at the carboxy-terminus of the A1 fragment region. In certain further embodiments, the disrupted furin-cleavage motif comprises an amino acid residue substitution in the furin-cleavage motif relative to a wild-type Shiga toxin A Subunit. In certain further embodiments, the substitution of the amino acid residue in the furin-cleavage motif is of an arginine residue with a non-positively charged, amino acid residue selected from the group consisting of: alanine, glycine, proline, serine, threonine, aspartate, asparagine, glutamate, glutamine, cysteine, isoleucine, leucine, methionine, valine, phenylalanine, tryptophan, and tyrosine. In certain embodiments, the substitution of the amino acid residue in the furin-cleavage motif is of an arginine residue with a histidine.

In certain embodiments of Embodiment Set #1, the Shiga toxin effector polypeptide, either alone or as a component of a first cell-targeting molecule, is capable when introduced to cells of exhibiting cytotoxicity comparable to the cytotoxicity of a wild-type Shiga toxin A1 polypeptide and/or second cell-targeting molecule consisting of the first cell-targeting molecule except for all of its Shiga toxin effector polypeptide component(s) each comprise a wild-type Shiga toxin A1 fragment.

For certain embodiments of the Shiga toxin effector polypeptide of Embodiment Set #1, a cell-targeting molecule of the present invention comprising the Shiga toxin effector polypeptide is capable when introduced to a chordate of exhibiting improved, in vivo tolerability compared to a second cell-targeting molecule consisting of the first cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region.

In certain embodiments of Embodiment Set #1, the Shiga toxin effector polypeptide of the present invention comprises a Shiga toxin effector region derived from amino acids 75 to 251 of SEQ ID NO:1, SEQ ID NO:2, or SEQ ID NO:3.

In certain embodiments of Embodiment Set #1, the Shiga toxin effector polypeptide of the present invention comprises a Shiga toxin effector region derived from amino acids 1 to 241 of SEQ ID NO:1, SEQ ID NO:2, or SEQ ID NO:3. In certain further embodiments, the Shiga toxin effector region is derived from amino acids 1 to 251 of SEQ ID NO:1, SEQ ID NO:2, or SEQ ID NO:3. In certain further embodiments, the Shiga toxin effector region is derived from amino acids 1 to 261 of SEQ ID NO:1, SEQ ID NO:2, or SEQ ID NO:3.

Embodiment Set #2—Cell-Targeting Molecule Comprising a De-Immunized Shiga Toxin Effector Polypeptide Comprising an Embedded or Inserted, Heterologous, T-Cell Epitope and a Non-Overlapping De-Immunized Sub-Region The present invention provides cell-targeting molecules, each comprising (i) a binding region capable of specifically binding an extracellular target biomolecule and (ii) a de-immunized, Shiga toxin effector polypeptide of Embodiment Set #1 (see e.g. FIG. 1, depicting illustrative examples of four, exemplary embodiments of the cell-targeting molecules of this embodiment set #2). For example, certain embodiments of set #2 is the cell-targeting molecule comprising (i) a binding region capable of specifically binding an extracellular target biomolecule and (ii) a de-immunized, Shiga toxin effector polypeptide comprising at least one inserted or embedded, heterologous epitope (a) and at least one disrupted, endogenous, B-cell and/or CD4+ T-cell epitope region (b), wherein the heterologous epitope does not overlap with the embedded or inserted, heterologous, T-cell epitope. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous, T-cell epitope is a CD8+ T-cell epitope, such as, e.g., with regard to a human immune system. For certain further embodiments, the heterologous, T-cell epitope is capable of being presented by a MHC class I molecule of a cell. In certain further embodiments, the cell-targeting molecule of the present invention is capable of one or more the following: entering a cell, inhibiting a ribosome function, causing cytostasis, causing cell death, and/or delivering the embedded or inserted, heterologous, T-cell epitope to a MHC class I molecule for presentation on a cellular surface. For certain further embodiments, the cell-targeting molecule is capable when introduced to cells of exhibiting a cytotoxicity comparable or better than a reference molecule, such as, e.g., a second cell-targeting molecule consisting of the cell-targeting molecule except for all of its Shiga toxin effector polypeptide component(s) each comprise a wild-type Shiga toxin A1 fragment.

For certain embodiments of Embodiment Set #2, the cell-targeting molecule comprises a molecular moiety located carboxy-terminal to the carboxy-terminus of the Shiga toxin A1 fragment region.

For certain embodiments of Embodiment Set #2, the cell-targeting molecule of the present invention is capable when introduced to a chordate of exhibiting improved in vivo tolerability and/or stability compared to a reference molecule, such as, e.g., a second cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region. In certain further embodiments, the Shiga toxin effector polypeptide is not cytotoxic and the molecular moiety is cytotoxic.

In certain embodiments of Embodiment Set #2, the binding region and Shiga toxin effector polypeptide are linked together, either directly or indirectly.

In certain embodiments of Embodiment Set #2, the binding region comprises a polypeptide comprising an immunoglobulin-type binding region. In certain further embodiments, the binding region comprising a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystalline-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality.

For certain embodiments of Embodiment Set #2, the cell-targeting molecule of the present invention is capable of exhibiting (i) a catalytic activity level comparable to a wild-type Shiga toxin A1 fragment or wild-type Shiga toxin effector polypeptide, (ii) a activity with a half-maximal inhibitory concentration ($IC_{50}$) value of 10,000 picomolar or less, and/or (iii) a significant level of Shiga toxin catalytic activity.

For certain embodiments of Embodiment Set #2, the cell-targeting molecule of the present invention and/or its Shiga toxin effector polypeptide is capable of exhibiting subcellular routing efficiency comparable to a reference cell-targeting molecule comprising a wild-type Shiga toxin A1 fragment or wild-type Shiga toxin effector polypeptide and/or capable of exhibiting a significant level of intracellular routing activity to the endoplasmic reticulum and/or cytosol from an endosomal starting location of a cell.

For certain embodiments of Embodiment Set #2, whereby administration of the cell-targeting molecule of the present invention to a cell physically coupled with the extracellular target biomolecule of the cell-targeting molecule's binding region, the cell-targeting molecule is capable of causing death of the cell. In certain further embodiments, administration of the cell-targeting molecule of the invention to two different populations of cell types which differ with respect to the presence or level of the extracellular target biomolecule, the cell-targeting molecule is capable of causing cell death to the cell-types physically coupled with an extracellular target biomolecule of the cytotoxic cell-targeting molecule's binding region at a $CD_{50}$ at least three times or less than the $CD_{50}$ to cell types which are not physically coupled with an extracellular target biomolecule of the cell-targeting molecule's binding region. For certain embodiments, whereby administration of the cell-targeting molecule of the present invention to a first populations of cells whose members are physically coupled to extracellular target biomolecules of the cell-targeting molecule's binding region, and a second population of cells whose members are not physically coupled to any extracellular target biomolecule of the binding region, the cytotoxic effect of the cell-targeting molecule to members of said first population of cells relative to members of said second population of cells is at least 3-fold greater. For certain embodiments, whereby administration of the cell-targeting molecule of the present invention to a first populations of cells whose members are physically coupled to a significant amount of the extracellular target biomolecule of the cell-targeting molecule's binding region, and a second population of cells whose members are not physically coupled to a significant amount of any extracellular target biomolecule of the binding region, the cytotoxic effect of the cell-targeting molecule to members of said first population of cells relative to members of said second population of cells is at least 3-fold greater. For certain embodiments, whereby administration of the cell-targeting molecule of the present invention to a first population of target biomolecule positive cells, and a second population of cells whose members do not express a significant amount of a target biomolecule of the cell-targeting molecule's binding region at a cellular surface, the cytotoxic effect of the cell-targeting molecule to members of the first population of cells relative to members of the second population of cells is at least 3-fold greater.

For certain embodiments of Embodiment Set #2, the cell-targeting molecule of the present invention is capable when introduced to cells of exhibiting a cytotoxicity with a half-maximal inhibitory concentration ($CD_{50}$) value of 300 nM or less and/or capable of exhibiting a significant level of Shiga toxin cytotoxicity.

For certain embodiments of Embodiment Set #2, the cell-targeting molecule of the present invention is capable of delivering an embedded or inserted, heterologous, CD8+ T-cell epitope to a MHC class I presentation pathway of a cell for cell-surface presentation of the epitope bound by a MHC class I molecule.

In certain embodiments of Embodiment Set #2, the cell-targeting molecule comprises a molecular moiety associated with the carboxy-terminus of the Shiga toxin effector polypeptide. In certain embodiments, the molecular moiety comprises or consists of the binding region. In certain embodiments, the molecular moiety comprises at least one amino acid and the Shiga toxin effector polypeptide is linked to at least one amino acid residue of the molecular moiety. In certain further embodiments, the molecular moiety and the Shiga toxin effector polypeptide are fused forming a continuous polypeptide.

In certain embodiments of Embodiment Set #2, the cell-targeting molecule further comprises a cytotoxic molecular moiety associated with the carboxy-terminus of the Shiga toxin effector polypeptide. For certain embodiments, the cytotoxic molecular moiety is a cytotoxic agent, such as, e.g., a small molecule chemotherapeutic agent, anti-neoplastic agent, cytotoxic antibiotic, alkylating agent, antimetabolite, topoisomerase inhibitor, and/or tubulin inhibitor known to the skilled worker and/or described herein. For certain further embodiments, the cytotoxic molecular moiety is cytotoxic at concentrations of less than 10,000, 5,000, 1,000, 500, or 200 pM.

In certain embodiments of Embodiment Set #2, the binding region is capable of binding to an extracellular target biomolecule selected from the group consisting of: CD20, CD22, CD40, CD74, CD79, CD25, CD30, HER2/neu/ErbB2, EGFR, EpCAM, EphB2, prostate-specific membrane antigen, Cripto, CDCP1, endoglin, fibroblast activated protein, Lewis-Y, CD19, CD21, CS1/SLAMF7, CD33, CD52, CD133, CEA, gpA33, mucin, TAG-72, tyrosine-protein kinase transmembrane receptor (ROR1 or NTRKR1), carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, c-MET, IGF1R, EphA3, TRAIL-R1, TRAIL-R2, RANK, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, HPV-E7, Epstein-Barr virus antigen, Bcr-Abl, alpha-fetoprotein antigen, 17-A1, bladder tumor antigen, CD38, CD15, CD23, CD45 (protein tyrosine phosphatase receptor type C), CD53, CD88, CD129, CD183, CD191, CD193, CD244, CD294, CD305, C3AR, FceRIa, galectin-9, IL-1R (interleukin-1 receptor), mrp-14, NKG2D ligand, programmed death-ligand 1 (PD-L1), Siglec-8, Siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC class I molecule, MHC class II molecule (optionally complexed with a peptide), CD284 (TLR4), CD107-Mac3, CD195 (CCR5), HLA-DR, CD16/32, CD282 (TLR2), CD11c, and any immunogenic fragment of any of the foregoing.

In certain embodiments of Embodiment Set #2, the binding region is linked, either directly or indirectly, to the Shiga toxin effector polypeptide by at least one covalent bond which is not a disulfide bond. In certain further embodiments, the binding region is fused, either directly or indirectly, to the carboxy-terminus of the Shiga toxin effector polypeptide to form a single, continuous polypeptide. In certain further embodiments, the binding region is an immunoglobulin-type binding region.

In certain embodiments of Embodiment Set #2, the disrupted furin-cleavage motif comprises one or more mutations in the minimal, furin-cleavage site relative to a wild-type Shiga toxin A Subunit. In certain embodiments, the disrupted furin-cleavage motif is not an amino-terminal truncation of sequences that overlap with part or all of at least one amino acid residue of the minimal furin-cleavage site. In certain embodiments, the mutation in the minimal, furin-cleavage site is an amino acid deletion, insertion, and/or substitution of at least one amino acid residue in the R/Y-x-x-R furin cleavage motif. In certain further embodiments, the disrupted furin-cleavage motif comprises at least one mutation relative to a wild-type Shiga toxin A Subunit, the mutation altering at least one amino acid residue in the region natively positioned 1) at 248-251 of the A Subunit of Shiga-like toxin 1 (SEQ ID NO: 1) or Shiga toxin (SEQ ID NO: 2), or 2) at 247-250 of the A Subunit of Shiga-like toxin 2 (SEQ ID NO:3), or the equivalent amino acid sequence position in any Shiga toxin A Subunit. In certain further embodiments, the mutation is an amino acid residue substitution of an arginine residue with a non-positively charged, amino acid residue.

In certain embodiments of Embodiment Set #2, the cell-targeting molecule of the present invention is capable when introduced to cells of exhibiting cytotoxicity comparable to a cytotoxicity of a reference molecule, such as, e.g., a second cell-targeting molecule consisting of the cell-targeting molecule except for all of its Shiga toxin effector polypeptide component(s) each comprise a wild-type Shiga toxin A1 fragment.

In certain embodiments of Embodiment Set #2, the binding region comprises the peptide or polypeptide shown in any one of SEQ ID NOs: 83-339. In certain further embodiments, the binding region comprises or consists essentially of the polypeptide represented by any of the following: amino acids 1-245 of any one of SEQ ID NOs: 33, 64, and 65; 269-513 of SEQ ID NO:40 or SEQ ID NO:80; amino acids 269-520 or 269-521 of any one of SEQ ID NOs: 36, 66, and 67; amino acids 1-232, 1-233, 1-234, 1-235, 1-236, 1-242, 1-243, 1-244, 1-245, 1-246, 1-252, 1-253, 1-254, 1-255, or 1-256 of any one of SEQ ID NOs: 47-119 and 176-248; amino acids 269-498 or 269-499 of any one of SEQ ID NOs: 37-39, 68-79, and 81; amino acids 269-499, 269-512, 269-513, or 280-510 of any one of SEQ ID NOs: 34, 35, 41-56, and 82.

In certain embodiments of Embodiment Set #2, the cell-targeting molecule of the present invention comprises or consists essentially of the polypeptide shown in any one of SEQ ID NOs: 43-62, 64-82, and 439-513.

In certain embodiments of Embodiment Set #2, the binding region sterically covers the carboxy-terminus of the A1 fragment region.

In certain embodiments of Embodiment Set #2, the molecular moiety sterically covers the carboxy-terminus of the A1 fragment region. In certain further embodiments, the molecular moiety comprises the binding region.

In certain embodiments of Embodiment Set #2, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #2, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #2, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #2, the amino-terminus of the Shiga toxin effector polypeptide is at and/or proximal to an amino-terminus of a polypeptide component of the cell-targeting molecule. In certain further embodiments, the binding region is not located proximally to the amino-terminus of the cell-targeting molecule relative to the Shiga toxin effector polypeptide. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. For certain further embodiments, the cell-targeting molecule of the present invention is capable when introduced to cells of exhibiting cytotoxicity that is greater than that of a third cell-targeting molecule having an amino-terminus and comprising the binding region and the Shiga toxin effector polypeptide which is not positioned at or proximal to the amino-terminus of the third cell-targeting molecule. For certain further embodiments, the cell-targeting molecule of the present invention exhibits cytotoxicity with better optimized, cytotoxic potency, such as, e.g., 4-fold, 5-fold, 6-fold, 9-fold, or greater cytotoxicity as compared to the cytotoxicity of the third cell-targeting molecule. For certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the third cell-targeting molecule to a second population of target positive cells as assayed by $CD_{50}$ values. In certain further embodiments, the third cell-targeting molecule does not comprise any carboxy-terminal, endoplasmic reticulum retention/retrieval signal motif of the KDEL family ("KDEL" disclosed as SEQ ID NO: 514).

In certain embodiments of Embodiment Set #2, the amino-terminus of the Shiga toxin effector polypeptide is at and/or proximal to an amino-terminus of a polypeptide component of the cell-targeting molecule. In certain further embodiments, the binding region is not located proximally to the amino-terminus of the cell-targeting molecule relative to the Shiga toxin effector polypeptide. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. For certain further embodiments, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a third cell-targeting molecule having an amino-terminus and comprising the binding region and the Shiga toxin effector polypeptide which is not positioned at or proximal to the amino-terminus of the third cell-targeting molecule. In certain further embodiments, the third cell-targeting molecule does not comprise any carboxy-terminal, endoplasmic reticulum retention/retrieval signal motif of the KDEL family.

In certain embodiments of Embodiment Set #2, the amino-terminus of the Shiga toxin effector polypeptide is at and/or proximal to an amino-terminus of a polypeptide component of the cell-targeting molecule. In certain further embodiments, the binding region is not located proximally to the amino-terminus of the cell-targeting molecule relative to the Shiga toxin effector polypeptide. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. For certain further embodiments, the cell-targeting molecule of the present invention exhibits low cytotoxic potency (i.e. is not capable when introduced to certain positive target cell types of exhibiting a cytotoxicity greater than 1% cell death of a cell population at a cell-targeting molecule concentration of 1000 nM, 500 nM, 100 nM, 75 nM, or 50 nM) and is capable when introduced to cells of exhibiting a greater subcellular routing efficiency from an extracellular space to a subcellular compartment of an endoplasmic reticulum and/or cytosol as compared to the cytotoxicity of a third cell-targeting molecule having an amino-terminus and comprising the binding region and the Shiga toxin effector polypeptide which is not positioned at or proximal to the amino-terminus of the third cell-targeting molecule. In certain further embodiments, the third cell-targeting molecule does not comprise any carboxy-terminal, endoplasmic reticulum retention/retrieval signal motif of the KDEL family.

In certain embodiments of Embodiment Set #2, the cell-targeting molecule of the present invention, or a polypeptide component thereof, comprises a carboxy-terminal, endoplasmic reticulum retention/retrieval signal motif of a member of the KDEL family. For certain further embodiments, the carboxy-terminal endoplasmic reticulum retention/retrieval signal motif is selected from the group consisting of: KDEL (SEQ ID NO: 514), HDEF (SEQ ID NO: 561), HDEL (SEQ ID NO: 515), RDEF (SEQ ID NO: 562), RDEL (SEQ ID NO: 516), WDEL (SEQ ID NO: 517), YDEL (SEQ ID NO: 518), HEEF (SEQ ID NO: 563), HEEL (SEQ ID NO: 519), KEEL (SEQ ID NO: 520), REEL (SEQ ID NO: 521), KAEL (SEQ ID NO: 564), KCEL (SEQ ID NO: 565), KFEL (SEQ ID NO: 522), KGEL (SEQ ID NO: 566), KHEL (SEQ ID NO: 567), KLEL (SEQ ID NO: 568), KNEL (SEQ ID NO: 569), KQEL (SEQ ID NO: 570), KREL (SEQ ID NO: 571), KSEL (SEQ ID NO: 572), KVEL (SEQ ID NO: 573), KWEL (SEQ ID NO: 574), KYEL (SEQ ID NO: 575), KEDL (SEQ ID NO: 576), KIEL (SEQ ID NO: 523), DKEL (SEQ ID NO: 524), FDEL (SEQ ID NO: 577), KDEF (SEQ ID NO: 578), KKEL (SEQ ID NO: 525), HADL (SEQ ID NO: 579), HAEL (SEQ ID NO: 580), HIEL (SEQ ID NO: 581), HNEL (SEQ ID NO: 526), HTEL (SEQ ID NO: 527), KTEL (SEQ ID NO: 528), HVEL (SEQ ID NO: 529), NDEL (SEQ ID NO: 582), QDEL (SEQ ID NO: 583), REDL (SEQ ID NO: 584), RNEL (SEQ ID NO: 585), RTDL (SEQ ID NO: 586), RTEL (SEQ ID NO: 587), SDEL (SEQ ID NO: 588), TDEL (SEQ ID NO: 589), SKEL (SEQ ID NO: 590), STEL (SEQ ID NO: 591), and EDEL (SEQ ID NO: 592). In certain further embodiments, the cell-targeting molecule of the present invention is capable when introduced to cells of exhibiting cytotoxicity that is greater than that of a fourth cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to a reference molecule, such as, e.g., the fourth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the fourth cell-targeting molecule to a second population of target positive cells as assayed by $CD_{50}$ values.

Embodiment Set #3—Cell-Targeting Molecule Comprising a Carboxy-Terminal Endoplasmic Reticulum Retention/Retrieval Signal Motif and a Shiga Toxin Effector Polypeptide Comprising an Embedded or Inserted, Heterologous, T-Cell Epitope The present invention provides cell-targeting molecules, each comprising (i) a binding region capable of specifically binding an extracellular target biomolecule; (ii) a Shiga toxin effector polypeptide comprising an inserted or embedded, heterologous, epitope; and (iii) a carboxy-terminal, endoplasmic reticulum retention/retrieval signal motif. In certain embodiments, the cell-targeting molecule of the present invention comprises (a) a binding region capable of specifically binding at least one extracellular target biomolecule; (b) a Shiga toxin effector polypeptide comprising an embedded or inserted, heterologous epitope; and (c) a carboxy-terminal, endoplasmic reticulum retention/retrieval signal motif of a member of the KDEL family. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous, T-cell epitope is a CD8+ T-cell epitope, such as, e.g., with regard to a human immune system. For certain further embodiments, the heterologous, T-cell epitope is capable of being presented by a MHC class I molecule of a cell. In certain further embodiments, the cell-targeting molecule of the present invention is capable of one or more the following: entering a cell, inhibiting a ribosome function, causing cytostasis, causing cell death, and/or delivering the embedded or inserted, heterologous, T-cell epitope to a MHC class I molecule for presentation on a cellular surface.

In certain embodiments of Embodiment Set #3, the carboxy-terminal endoplasmic reticulum retention/retrieval signal motif is selected from the group consisting of: KDEL (SEQ ID NO: 514), HDEF (SEQ ID NO: 561), HDEL (SEQ ID NO: 515), RDEF (SEQ ID NO: 562), RDEL (SEQ ID NO: 516), WDEL (SEQ ID NO: 517), YDEL (SEQ ID NO: 518), HEEF (SEQ ID NO: 563), HEEL (SEQ ID NO: 519), KEEL (SEQ ID NO: 520), REEL (SEQ ID NO: 521), KAEL (SEQ ID NO: 564), KCEL (SEQ ID NO: 565), KFEL (SEQ ID NO: 522), KGEL (SEQ ID NO: 566), KHEL (SEQ ID NO: 567), KLEL (SEQ ID NO: 568), KNEL (SEQ ID NO: 569), KQEL (SEQ ID NO: 570), KREL (SEQ ID NO: 571), KSEL (SEQ ID NO: 572), KVEL (SEQ ID NO: 573), KWEL (SEQ ID NO: 574), KYEL (SEQ ID NO: 575), KEDL (SEQ ID NO: 576), KIEL (SEQ ID NO: 523), DKEL (SEQ ID NO: 524), FDEL (SEQ ID NO: 577), KDEF (SEQ ID NO: 578), KKEL (SEQ ID NO: 525), HADL (SEQ ID NO: 579), HAEL (SEQ ID NO: 580), HIEL (SEQ ID NO: 581), HNEL (SEQ ID NO: 526), HTEL (SEQ ID NO: 527), KTEL (SEQ ID NO: 528), HVEL (SEQ ID NO: 529), NDEL (SEQ ID NO: 582), QDEL (SEQ ID NO: 583), REDL (SEQ ID NO: 584), RNEL (SEQ ID NO: 585), RTDL (SEQ ID NO: 586), RTEL (SEQ ID NO: 587), SDEL (SEQ ID NO: 588), TDEL (SEQ ID NO: 589), SKEL (SEQ ID NO: 590), STEL (SEQ ID NO: 591), and EDEL (SEQ ID NO: 592).

In certain embodiments of Embodiment Set #3, the embedded or inserted, heterologous, T-cell epitope disrupts the endogenous, B-cell and/or T-cell epitope region selected from the group of natively positioned Shiga toxin A Subunit regions consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3, or the equivalent region in a Shiga toxin A Subunit or derivative thereof, (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2, or the equivalent region in a Shiga toxin A Subunit or derivative thereof.

In certain further embodiments of Embodiment Set #3, the heterologous epitope is a CD8+ T-cell epitope capable of being presented by a MHC class I molecule of a cell. In certain further embodiments, the heterologous epitope in is embedded and replaces an equivalent number of amino acid residues in a wild-type Shiga toxin polypeptide region such that the Shiga toxin effector polypeptide has the same total number of amino acid residues as does the wild-type Shiga toxin polypeptide region from which it is derived. In certain further embodiments of any of the above, the Shiga toxin effector polypeptide is capable of exhibiting at least one Shiga toxin effector function selected from: directing intracellular routing to a cytosol of a cell in which the polypeptide is present, inhibiting a ribosome function, enzymatically inactivating a ribosome, and cytotoxicity.

In certain embodiments of Embodiment Set #3, the cell-targeting molecule of the present invention is capable when introduced to cells of exhibiting cytotoxicity that is greater than that of a fifth cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the fifth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the fifth cell-targeting molecule to a second population of target positive cells as assayed by $CD_{50}$ values.

For certain embodiments of Embodiment Set #3, the cell-targeting molecule of the present invention is capable of delivering an embedded or inserted, heterologous, CD8+ T-cell epitope to a MHC class I presentation pathway of a cell for cell-surface presentation of the epitope bound by a MHC class I molecule.

In certain embodiments of Embodiment Set #3, the cell-targeting molecule is de-immunized due to the embedded or inserted, heterologous, epitope. In certain further embodiments, the cell-targeting molecule is capable of exhibiting less relative antigenicity and/or relative immunogenicity as compared to a reference molecule, such as, e.g., a sixth cell-targeting molecule consisting of the cell-targeting molecule except for it lacks one or more embedded or inserted epitopes present in the cell targeting molecule.

For certain further embodiments of Embodiment Set #3, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the fifth cell-targeting molecule.

Embodiment Set #4—Cell-Targeting Molecule Comprising a Shiga Toxin Effector Polypeptide Comprising (i) an Embedded or Inserted, Heterologous, T-Cell Epitope and (ii) a Disrupted, Furin-Cleavage Motif The present invention provides cell-targeting molecules, each comprising (i) a binding region capable of specifically binding an extracellular target biomolecule; (ii) a Shiga toxin effector polypeptide comprising an inserted or embedded, heterologous, epitope; and (iii) a disrupted furin-cleavage motif. In certain embodiments, the cell-targeting molecule of the present invention comprises (i) a binding region capable of specifically binding an extracellular target biomolecule; (ii) a Shiga toxin effector polypeptide comprising (a) an inserted or embedded, heterologous, epitope; (b) a Shiga toxin A1 fragment derived region having a carboxy terminus; and (c) a disrupted furin-cleavage motif at the carboxy-terminus of the A1 fragment region. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous, T-cell epitope is a CD8+ T-cell epitope, such as, e.g., with regard to a human immune system. For certain further embodiments, the heterologous, T-cell epitope is capable of being presented by a MHC class I molecule of a cell. In certain further embodiments, the cell-targeting molecule of the present invention is capable of one or more the following: entering a cell, inhibiting a ribosome function, causing cytostasis, causing cell death, and/or delivering the embedded or inserted, heterologous, T-cell epitope to a MHC class I molecule for presentation on a cellular surface. For certain further embodiments, the cell-targeting molecule is capable when introduced to cells of exhibiting a cytotoxicity comparable or better than a reference molecule, such as, e.g., a second cell-targeting molecule consisting of the cell-targeting molecule except for all of its Shiga toxin effector polypeptide components comprise a wild-type Shiga toxin furin-cleavage site at the carboxy terminus of its A1 fragment region.

In certain embodiments of Embodiment Set #4, the embedded or inserted, heterologous, T-cell epitope disrupts the endogenous, B-cell and/or T-cell epitope region selected from the group of natively positioned Shiga toxin A Subunit regions consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3, or the equivalent region in a Shiga toxin A Subunit or derivative thereof, (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2, or the equivalent region in a Shiga toxin A Subunit or derivative thereof.

In certain embodiments of Embodiment Set #4, the disrupted furin-cleavage motif comprises one or more mutations, relative to a wild-type Shiga toxin A Subunit, the mutation altering at least one amino acid residue in a region natively positioned at 248-251 of the A Subunit of Shiga-like toxin 1 (SEQ ID NO:1) or Shiga toxin (SEQ ID NO:2), or at 247-250 of the A Subunit of Shiga-like toxin (SEQ ID NO:3); or the equivalent region in a Shiga toxin A Subunit or derivative thereof. In certain further embodiments, the disrupted furin-cleavage motif comprises one or more mutations, relative to a wild-type Shiga toxin A Subunit, in a minimal furin cleavage site of the furin-cleavage motif. In certain further embodiments the minimal furin cleavage site is represented by the consensus amino acid sequence R/Y-x-x-R and/or R-x-x-R.

In certain embodiments of Embodiment Set #4, the cell-targeting molecule comprises a molecular moiety located carboxy-terminal to the carboxy-terminus of the Shiga toxin A1 fragment region.

In certain embodiments of Embodiment Set #4, the binding region sterically covers the carboxy-terminus of the A1 fragment region.

In certain embodiments of Embodiment Set #4, the molecular moiety sterically covers the carboxy-terminus of the A1 fragment region. In certain further embodiments, the molecular moiety comprises the binding region.

In certain embodiments of Embodiment Set #4, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #4, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #4, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #4, the disrupted furin-cleavage motif comprises an amino acid residue substitution in the furin-cleavage motif relative to a wild-type Shiga toxin A Subunit. In certain further embodiments, the substitution of the amino acid residue in the furin-cleavage motif is of an arginine residue with a non-positively charged, amino acid residue selected from the group consisting of: alanine, glycine, proline, serine, threonine, aspartate, asparagine, glutamate, glutamine, cysteine, isoleucine, leucine, methionine, valine, phenylalanine, tryptophan, and tyrosine. In certain embodiments, the substitution of the amino acid residue in the furin-cleavage motif is of an arginine residue with a histidine.

In certain embodiments of Embodiment Set #4, the cell-targeting molecule is capable when introduced to cells of exhibiting cytotoxicity comparable to the cytotoxicity of a seventh cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region. In certain further embodiments, the cell-targeting molecule of the present invention is capable when introduced to cells of exhibiting cytotoxicity that is in a range of from 0.1-fold, 0.5-fold, or 0.75-fold to 1.2-fold, 1.5-fold, 1.75-fold, 2-fold, 3-fold, 4-fold, or 5-fold of the cytotoxicity exhibited by the seventh cell-targeting molecule.

In certain embodiments of Embodiment Set #4, the cell-targeting molecule is capable when introduced to a chordate of exhibiting improved, in vivo tolerability compared to in vivo tolerability of the seventh cell-targeting molecule.

In certain embodiments of Embodiment Set #4, the cell-targeting molecule is de-immunized due to the embedded or inserted, heterologous, epitope. In certain further embodiments, the cell-targeting molecule is capable of exhibiting less relative antigenicity and/or relative immunogenicity as compared to a reference molecule, such as, e.g., an eighth cell-targeting molecule consisting of the cell-targeting molecule except for it lacks one or more embedded or inserted epitopes present in the cell targeting molecule.

In certain embodiments of Embodiment Set #4, the cell-targeting molecule is de-immunized due to the furin-cleavage motif disruption. In certain further embodiments, the cell-targeting molecule is capable of exhibiting less relative antigenicity and/or relative immunogenicity as compared to a ninth cell-targeting molecule consisting of the cell-targeting molecule except for the furin-cleavage motif is wild-type and/or all the Shiga toxin effector polypeptide components consist of a wild-type Shiga toxin A1 fragment.

Embodiment Set #5—Cell-Targeting Molecule Comprising a Shiga Toxin Effector Polypeptide at or Proximal to an Amino-Terminus and Wherein the Shiga Toxin Effector Polypeptide Comprises an Embedded or Inserted, Heterologous, T-Cell Epitope The present invention provides cell-targeting molecules, each comprising (i) a binding region capable of specifically binding an extracellular target biomolecule; (ii) a Shiga toxin effector polypeptide comprising an inserted or embedded, heterologous, epitope; wherein the Shiga toxin effector polypeptide is at or proximal to an amino-terminus of a polypeptide. In certain embodiments, the cell-targeting molecule of the present invention comprises (i) a binding region capable of specifically binding an extracellular target biomolecule, (ii) a polypeptide component, and (iii) a Shiga toxin effector polypeptide comprising an inserted or embedded, heterologous, epitope; wherein the Shiga toxin effector polypeptide is at or proximal to an amino-terminus of the polypeptide component of the cell-targeting molecule. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. In certain further embodiments, the binding region is not located proximally to an amino-terminus of the cell-targeting molecule relative to the Shiga toxin effector polypeptide. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the heterologous, T-cell epitope is a CD8+ T-cell epitope, such as, e.g., with regard to a human immune system. For certain further embodiments, the heterologous, T-cell epitope is capable of being presented by a MHC class I molecule of a cell. In certain further embodiments, the cell-targeting molecule of the present invention is capable of one or more the following: entering a cell, inhibiting a ribosome function, causing cytostasis, causing cell death, and/or delivering the embedded or inserted, heterologous, T-cell epitope to a MHC class I molecule for presentation on a cellular surface.

In certain embodiments of Embodiment Set #5, the cell-targeting molecule of the present invention is capable when introduced to cells of exhibiting cytotoxicity that is greater than that of a tenth cell-targeting molecule having an amino-terminus and comprising the binding region and the Shiga toxin effector polypeptide region which is not positioned at or proximal to the amino-terminus of the tenth cell-targeting molecule. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the tenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the tenth cell-targeting molecule to a second population of target positive cells as assayed by $CD_{50}$ values.

For certain embodiments of Embodiment Set #5, the cell-targeting molecule of the present invention is capable of delivering an embedded or inserted, heterologous, CD8+ T-cell epitope to a MHC class I presentation pathway of a cell for cell-surface presentation of the epitope bound by a MHC class I molecule.

In certain embodiments of Embodiment Set #5, the cell-targeting molecule is de-immunized due to the embedded or inserted, heterologous, epitope. In certain further embodiments, the cell-targeting molecule is capable of exhibiting less relative antigenicity and/or relative immunogenicity as compared to a reference molecule, such as, e.g., an eleventh cell-targeting molecule consisting of the cell-targeting molecule except for it lacks one or more embedded or inserted epitopes present in the cell targeting molecule.

For certain further embodiments of Embodiment Set #5, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the tenth cell-targeting molecule.

Embodiment Set #6—Cell-Targeting Molecule Comprising a De-Immunized Shiga Toxin Effector Polypeptide Comprising a Disrupted, Furin-Cleavage Motif The present invention provides cell-targeting molecules, each comprising (i) a binding region capable of specifically binding an extracellular target biomolecule and (ii) a de-immunized, Shiga toxin effector polypeptide comprising a disrupted furin-cleavage motif. In certain embodiments, the cell-targeting molecule of the present invention comprises (i) a binding region capable of specifically binding an extracellular target biomolecule and (ii) a de-immunized, Shiga toxin effector polypeptide comprising (a) a Shiga toxin A1 fragment derived region having a carboxy terminus, (b) a disrupted furin-cleavage motif at the carboxy-terminus of the A1 fragment region, and (c) at least one disrupted, endogenous, B-cell and/or CD4+ T-cell epitope and/or epitope region. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death. For certain further embodiments, the cell-targeting molecule is capable when introduced to cells of exhibiting a cytotoxicity comparable or better than a reference molecule, such as, e.g., a second cell-targeting molecule consisting of the cell-targeting molecule except for all of its Shiga toxin effector polypeptide components comprise a wild-type Shiga toxin furin-cleavage site at the carboxy terminus of its A1 fragment region.

In certain embodiments of Embodiment Set #6, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of: 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2, and 210-218 of SEQ ID NO:3; 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; 285-293 of SEQ ID NO:1 or SEQ ID NO:2; 4-33 of SEQ ID NO:1 or SEQ ID NO:2; 34-78 of SEQ ID NO:1 or SEQ ID NO:2; 77-103 of SEQ ID NO:1 or SEQ ID NO:2; 128-168 of SEQ ID NO:1 or SEQ ID NO:2; 160-183 of SEQ ID NO:1 or SEQ ID NO:2; 236-258 of SEQ ID NO:1 or SEQ ID NO:2; and 274-293 of SEQ ID NO:1 or SEQ ID NO:2; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments of Embodiment Set #6, the disrupted furin-cleavage motif comprises one or more mutations, relative to a wild-type Shiga toxin A Subunit, the mutation altering at least one amino acid residue in a region natively positioned at 248-251 of the A Subunit of Shiga-like toxin 1 (SEQ ID NO:1) or Shiga toxin (SEQ ID NO:2), or at 247-250 of the A Subunit of Shiga-like toxin (SEQ ID NO:3); or the equivalent region in a Shiga toxin A Subunit or derivative thereof. In certain further embodiments, the disrupted furin-cleavage motif comprises one or more mutations, relative to a wild-type Shiga toxin A Subunit, in a minimal furin cleavage site of the furin-cleavage motif. In certain further embodiments the minimal furin cleavage site is represented by the consensus amino acid sequence R/Y-x-x-R and/or R-x-x-R.

In certain embodiments of Embodiment Set #6, the cell-targeting molecule comprises a molecular moiety located carboxy-terminal to the carboxy-terminus of the Shiga toxin A1 fragment region.

In certain embodiments of Embodiment Set #6, the binding region sterically covers the carboxy-terminus of the A1 fragment region.

In certain embodiments of Embodiment Set #6, the molecular moiety sterically covers the carboxy-terminus of the A1 fragment region. In certain further embodiments, the molecular moiety comprises the binding region.

In certain embodiments of Embodiment Set #6, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #6, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #6, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #6, the disrupted furin-cleavage motif comprises an amino acid residue substitution in the furin-cleavage motif relative to a wild-type Shiga toxin A Subunit. In certain further embodiments, the substitution of the amino acid residue in the furin-cleavage motif is of an arginine residue with a non-positively charged, amino acid residue selected from the group consisting of: alanine, glycine, proline, serine, threonine, aspartate, asparagine, glutamate, glutamine, cysteine, isoleucine, leucine, methionine, valine, phenylalanine, tryptophan, and tyrosine. In certain embodiments, the substitution of the amino acid residue in the furin-cleavage motif is of an arginine residue with a histidine.

In certain embodiments of Embodiment Set #6, the cell-targeting molecule is capable when introduced to cells of exhibiting cytotoxicity comparable to the cytotoxicity of a reference molecule, such as, e.g., a twelfth cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region. In certain further embodiments, the cell-targeting molecule of the present invention is capable when introduced to cells of exhibiting cytotoxicity that is in a range of from 0.1-fold, 0.5-fold, or 0.75-fold to 1.2-fold, 1.5-fold, 1.75-fold, 2-fold, 3-fold, 4-fold, or 5-fold of the cytotoxicity exhibited by the twelfth cell-targeting molecule.

In certain embodiments of Embodiment Set #4, the cell-targeting molecule is capable when introduced to a chordate of exhibiting improved, in vivo tolerability compared to in vivo tolerability of the twelfth cell-targeting molecule.

In certain embodiments of Embodiment Set #4, the cell-targeting molecule is de-immunized due to the furin-cleavage motif disruption. In certain further embodiments, the cell-targeting molecule is capable of exhibiting less relative antigenicity and/or relative immunogenicity as compared to a reference cell-targeting molecule consisting of the cell-targeting molecule except for the furin-cleavage motif is wild-type and/or all the Shiga toxin effector polypeptide components consist of a wild-type Shiga toxin A1 fragment, such as, e.g., the twelfth cell-targeting molecule.

Embodiment Set #7—Cell-Targeting Molecule Comprising a Carboxy-Terminal Endoplasmic Reticulum Retention/Retrieval Signal Motif and a De-Immunized Shiga Toxin Effector Polypeptide The present invention provides cell-targeting molecules, each comprising (i) a binding region capable of specifically binding an extracellular target biomolecule; (ii) a de-immunized, Shiga toxin effector polypeptide, and (iii) a carboxy-terminal, endoplasmic reticulum retention/retrieval signal motif. In certain embodiments, the cell-targeting molecule of the present invention comprises (i) a binding region capable of specifically binding an extracellular target biomolecule; (ii) a de-immunized, Shiga toxin effector polypeptide comprising at least one disrupted, endogenous, B-cell and/or CD4+ T-cell epitope and/or epitope region, and (iii) a carboxy-terminal, endoplasmic reticulum retention/retrieval signal motif of a member of the KDEL family. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death.

In certain embodiments of Embodiment Set #7, the carboxy-terminal endoplasmic reticulum retention/retrieval signal motif is selected from the group consisting of: KDEL (SEQ ID NO: 514), HDEF (SEQ ID NO: 561), HDEL (SEQ ID NO: 515), RDEF (SEQ ID NO: 562), RDEL (SEQ ID NO: 516), WDEL (SEQ ID NO: 517), YDEL (SEQ ID NO: 518), HEEF (SEQ ID NO: 563), HEEL (SEQ ID NO: 519), KEEL (SEQ ID NO: 520), REEL (SEQ ID NO: 521), KAEL (SEQ ID NO: 564), KCEL (SEQ ID NO: 565), KFEL (SEQ ID NO: 522), KGEL (SEQ ID NO: 566), KHEL (SEQ ID NO: 567), KLEL (SEQ ID NO: 568), KNEL (SEQ ID NO: 569), KQEL (SEQ ID NO: 570), KREL (SEQ ID NO: 571), KSEL (SEQ ID NO: 572), KVEL (SEQ ID NO: 573), KWEL (SEQ ID NO: 574), KYEL (SEQ ID NO: 575), KEDL (SEQ ID NO: 576), KIEL (SEQ ID NO: 523), DKEL (SEQ ID NO: 524), FDEL (SEQ ID NO: 577), KDEF (SEQ ID NO: 578), KKEL (SEQ ID NO: 525), HADL (SEQ ID NO: 579), HAEL (SEQ ID NO: 580), HIEL (SEQ ID NO: 581), HNEL (SEQ ID NO: 526), HTEL (SEQ ID NO: 527), KTEL (SEQ ID NO: 528), HVEL (SEQ ID NO: 529), NDEL (SEQ ID NO: 582), QDEL (SEQ ID NO: 583), REDL (SEQ ID NO: 584), RNEL (SEQ ID NO: 585), RTDL (SEQ ID NO: 586), RTEL (SEQ ID NO: 587), SDEL (SEQ ID NO: 588), TDEL (SEQ ID NO: 589), SKEL (SEQ ID NO: 590), STEL (SEQ ID NO: 591), and EDEL (SEQ ID NO: 592).

In certain embodiments of Embodiment Set #7, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of: 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2, and 210-218 of SEQ ID NO:3; 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; 285-293 of SEQ ID NO:1 or SEQ ID NO:2; 4-33 of SEQ ID NO:1 or SEQ ID NO:2; 34-78 of SEQ ID NO:1 or SEQ ID NO:2; 77-103 of SEQ ID NO:1 or SEQ ID NO:2; 128-168 of SEQ ID NO:1 or SEQ ID NO:2; 160-183 of SEQ ID NO:1 or SEQ ID NO:2; 236-258 of SEQ ID NO:1 or SEQ ID NO:2; and 274-293 of SEQ ID NO:1 or SEQ ID NO:2; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments of Embodiment Set #7, the cell-targeting molecule of the present invention is capable when introduced to cells of exhibiting cytotoxicity that is greater than that of a thirteenth cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the thirteenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the thirteenth cell-targeting molecule to a second population of target positive cells as assayed by $CD_{50}$ values.

For certain further embodiments of Embodiment Set #7, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the thirteenth cell-targeting molecule.

Embodiment Set #8—Cell-Targeting Molecule Comprising a De-Immunized Shiga Toxin Effector Polypeptide at or Proximal to an Amino-Terminus of the Cell Targeting Molecule The present invention provides cell-targeting molecules, each comprising (i) a binding region capable of specifically binding an extracellular target biomolecule, (ii) a de-immunized, Shiga toxin effector polypeptide; wherein the Shiga toxin effector polypeptide is at or proximal to an amino-terminus. In certain embodiments, the cell-targeting molecule of the present invention comprises (i) a binding region capable of specifically binding an extracellular target biomolecule; (ii) polypeptide component; and (iii) a de-immunized, Shiga toxin effector polypeptide comprising at least one disrupted, endogenous, B-cell and/or CD4+ T-cell epitope and/or epitope region; wherein the Shiga toxin effector polypeptide is at or proximal to an amino-terminus of the polypeptide component of the cell-targeting molecule. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. In certain further embodiments, the binding region is not located proximally to an amino-terminus of the cell-targeting molecule relative to the Shiga toxin effector polypeptide. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death.

In certain embodiments of Embodiment Set #8, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of: 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2, and 210-218 of SEQ ID NO:3; 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; 285-293 of SEQ ID NO:1 or SEQ ID NO:2; 4-33 of SEQ ID NO:1 or SEQ ID NO:2; 34-78 of SEQ ID NO:1 or SEQ ID NO:2; 77-103 of SEQ ID NO:1 or SEQ ID NO:2; 128-168 of SEQ ID NO:1 or SEQ ID NO:2; 160-183 of SEQ ID NO:1 or SEQ ID NO:2; 236-258 of SEQ ID NO:1 or SEQ ID NO:2; and 274-293 of SEQ ID NO:1 or SEQ ID NO:2; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments of Embodiment Set #8, the cell-targeting molecule of the present invention is capable when introduced to cells of exhibiting cytotoxicity that is greater than that of a fourteenth cell-targeting molecule having an amino-terminus and comprising the binding region and the Shiga toxin effector polypeptide region which is not positioned at or proximal to the amino-terminus of the fourteenth cell-targeting molecule. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the fourteenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the fourteenth cell-targeting molecule to a second population of target positive cells as assayed by $CD_{50}$ values.

For certain further embodiments of Embodiment Set #8, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the fourteenth cell-targeting molecule.

Embodiment Set #9—Cell-Targeting Molecule Comprising a Carboxy-Terminal Endoplasmic Reticulum Retention/Retrieval Signal Motif and a Shiga Toxin Effector Polypeptide Comprising a Disrupted, Furin-Cleavage Motif The present invention provides cell-targeting molecules, each comprising (i) a binding region capable of specifically binding an extracellular target biomolecule; (ii) a Shiga toxin effector polypeptide comprising a disrupted furin-cleavage motif, and (iii) a carboxy-terminal endoplasmic reticulum retention/retrieval signal motif. The present invention provides cell-targeting molecules, each comprising (i) a binding region capable of specifically binding an extracellular target biomolecule; (ii) a Shiga toxin effector polypeptide comprising a disrupted furin-cleavage motif; and (iii) a carboxy-terminal, endoplasmic reticulum retention/retrieval signal motif of a member of the KDEL family. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death. For certain further embodiments, the cell-targeting molecule is capable when introduced to cells of exhibiting a cytotoxicity comparable or better than a reference molecule, such as, e.g., a second cell-targeting molecule consisting of the cell-targeting molecule except for all of its Shiga toxin effector polypeptide components comprise a wild-type Shiga toxin furin-cleavage site at the carboxy terminus of its A1 fragment region.

In certain embodiments of Embodiment Set #9, the disrupted furin-cleavage motif comprises one or more mutations, relative to a wild-type Shiga toxin A Subunit, the mutation altering at least one amino acid residue in a region natively positioned at 248-251 of the A Subunit of Shiga-like toxin 1 (SEQ ID NO:1) or Shiga toxin (SEQ ID NO:2), or at 247-250 of the A Subunit of Shiga-like toxin (SEQ ID NO:3); or the equivalent region in a Shiga toxin A Subunit or derivative thereof. In certain further embodiments, the disrupted furin-cleavage motif comprises one or more mutations, relative to a wild-type Shiga toxin A Subunit, in a minimal furin cleavage site of the furin-cleavage motif. In certain further embodiments the minimal furin cleavage site is represented by the consensus amino acid sequence R/Y-x-x-R and/or R-x-x-R.

In certain embodiments of Embodiment Set #9, the cell-targeting molecule comprises a molecular moiety located carboxy-terminal to the carboxy-terminus of the Shiga toxin A1 fragment region.

In certain embodiments of Embodiment Set #9, the binding region sterically covers the carboxy-terminus of the A1 fragment region.

In certain embodiments of Embodiment Set #9, the molecular moiety sterically covers the carboxy-terminus of the A1 fragment region. In certain further embodiments, the molecular moiety comprises the binding region.

In certain embodiments of Embodiment Set #9, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #9, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #9, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #9, the disrupted furin-cleavage motif comprises an amino acid residue substitution in the furin-cleavage motif relative to a wild-type Shiga toxin A Subunit. In certain further embodiments, the substitution of the amino acid residue in the furin-cleavage motif is of an arginine residue with a non-positively charged, amino acid residue selected from the group consisting of: alanine, glycine, proline, serine, threonine, aspartate, asparagine, glutamate, glutamine, cysteine, isoleucine, leucine, methionine, valine, phenylalanine, tryptophan, and tyrosine. In certain embodiments, the substitution of the amino acid residue in the furin-cleavage motif is of an arginine residue with a histidine.

In certain embodiments of Embodiment Set #9, the cell-targeting molecule of the present invention is capable when introduced to cells of exhibiting cytotoxicity that is greater than that of a fifteenth cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the fifteenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the fifteenth cell-targeting molecule to a second population of target positive cells as assayed by $CD_{50}$ values.

In certain embodiments of Embodiment Set #9, the cell-targeting molecule is capable when introduced to a chordate of exhibiting improved, in vivo tolerability compared to in vivo tolerability of a sixteenth cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region.

In certain embodiments of Embodiment Set #9, the cell-targeting molecule is de-immunized due to the furin-cleavage motif disruption. In certain further embodiments, the cell-targeting molecule is capable of exhibiting less relative antigenicity and/or relative immunogenicity as compared to a reference cell-targeting molecule consisting of the cell-targeting molecule except for the furin-cleavage motif is wild-type and/or all the Shiga toxin effector polypeptide components consist of a wild-type Shiga toxin A1 fragment, such as, e.g., the sixteenth cell-targeting molecule.

For certain further embodiments of Embodiment Set #9, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the fifteenth cell-targeting molecule.

Embodiment Set #10—Cell-Targeting Molecule Comprising a Furin-Cleavage Resistant Shiga Toxin Effector Polypeptide at or Proximal to an Amino-Terminus of the Cell Targeting Molecule The present invention provides cell-targeting molecules, each comprising (i) a binding region capable of specifically binding an extracellular target biomolecule and (ii) a Shiga toxin effector polypeptide comprising a disrupted furin-cleavage motif at the carboxy-terminus of its Shiga toxin A1 fragment region; wherein the amino-terminus of the Shiga toxin effector polypeptide is at and/or proximal to an amino-terminus of a polypeptide component of the cell-targeting molecule. In certain embodiments, the cell-targeting molecule of the present invention comprises (i) a binding region capable of specifically binding an extracellular target biomolecule, (ii) a Shiga toxin effector polypeptide having an amino-terminus and a Shiga toxin A1 fragment derived region having a carboxy terminus, and (iii) a disrupted furin-cleavage motif at the carboxy-terminus of the A1 fragment region; wherein the binding region is not located proximally to the amino-terminus of the cell-targeting molecule relative to the Shiga toxin effector polypeptide. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. In certain further embodiments, the binding region is not located proximally to an amino-terminus of the cell-targeting molecule relative to the Shiga toxin effector polypeptide. For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death. For certain further embodiments, the cell-targeting molecule is capable when introduced to cells of exhibiting a cytotoxicity comparable or better than a reference molecule, such as, e.g., a seventeenth cell-targeting molecule consisting of the cell-targeting molecule except for all of its Shiga toxin effector polypeptide components comprise a wild-type Shiga toxin furin-cleavage site at the carboxy terminus of its A1 fragment region.

In certain embodiments of Embodiment Set #10, the disrupted furin-cleavage motif comprises one or more mutations, relative to a wild-type Shiga toxin A Subunit, the mutation altering at least one amino acid residue in a region natively positioned at 248-251 of the A Subunit of Shiga-like toxin 1 (SEQ ID NO:1) or Shiga toxin (SEQ ID NO:2), or at 247-250 of the A Subunit of Shiga-like toxin (SEQ ID NO:3); or the equivalent region in a Shiga toxin A Subunit or derivative thereof. In certain further embodiments, the disrupted furin-cleavage motif comprises one or more mutations, relative to a wild-type Shiga toxin A Subunit, in a minimal furin cleavage site of the furin-cleavage motif. In certain further embodiments the minimal furin cleavage site is represented by the consensus amino acid sequence R/Y-x-x-R and/or R-x-x-R.

In certain embodiments of Embodiment Set #10, the cell-targeting molecule comprises a molecular moiety located carboxy-terminal to the carboxy-terminus of the Shiga toxin A1 fragment region.

In certain embodiments of Embodiment Set #10, the binding region sterically covers the carboxy-terminus of the A1 fragment region.

In certain embodiments of Embodiment Set #10, the molecular moiety sterically covers the carboxy-terminus of the A1 fragment region. In certain further embodiments, the molecular moiety comprises the binding region.

In certain embodiments of Embodiment Set #10, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Set #10, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Set #10, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

In certain embodiments of Embodiment Set #10, the disrupted furin-cleavage motif comprises an amino acid residue substitution in the furin-cleavage motif relative to a wild-type Shiga toxin A Subunit. In certain further embodiments, the substitution of the amino acid residue in the furin-cleavage motif is of an arginine residue with a non-positively charged, amino acid residue selected from the group consisting of: alanine, glycine, proline, serine, threonine, aspartate, asparagine, glutamate, glutamine, cysteine, isoleucine, leucine, methionine, valine, phenylalanine, tryptophan, and tyrosine. In certain embodiments, the substitution of the amino acid residue in the furin-cleavage motif is of an arginine residue with a histidine.

In certain embodiments of Embodiment Set #10, the cell-targeting molecule of the present invention is capable when introduced to cells of exhibiting cytotoxicity that is greater than that of a eighteenth cell-targeting molecule having an amino-terminus and comprising the binding region and the Shiga toxin effector polypeptide region which is not positioned at or proximal to the amino-terminus of the eighteenth cell-targeting molecule. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to the eighteenth cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the eighteenth cell-targeting molecule to a second population of target positive cells as assayed by $CD_{50}$ values.

In certain embodiments of Embodiment Set #10, the cell-targeting molecule is capable when introduced to a chordate of exhibiting improved, in vivo tolerability compared to in vivo tolerability of a nineteenth cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region.

In certain embodiments of Embodiment Set #10, the cell-targeting molecule is de-immunized due to the furin-cleavage motif disruption. In certain further embodiments, the cell-targeting molecule is capable of exhibiting less relative antigenicity and/or relative immunogenicity as compared to a reference cell-targeting molecule consisting of the cell-targeting molecule except for the furin-cleavage motif is wild-type and/or all the Shiga toxin effector polypeptide components consist of a wild-type Shiga toxin A1 fragment, such as, e.g., the nineteenth cell-targeting molecule.

For certain further embodiments of Embodiment Set #10, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the nineteenth cell-targeting molecule.

Embodiment Set #11—Cell-Targeting Molecule Comprising a Carboxy-Terminal Endoplasmic Reticulum Retention/Retrieval Signal Motif and Shiga Toxin Effector Polypeptide at or Proximal to an Amino-Terminus of the Cell Targeting Molecule The present invention provides cell-targeting molecules, each comprising (i) a binding region capable of specifically binding an extracellular target biomolecule, (ii) a carboxy-terminal, endoplasmic reticulum retention/retrieval signal motif, and (iii) a Shiga toxin effector polypeptide; wherein the amino-terminus of the Shiga toxin effector polypeptide is at and/or proximal to an amino-terminus of a polypeptide component of the cell-targeting molecule. In certain embodiments, the cell-targeting molecule of the present invention comprises a (i) binding region capable of specifically binding an extracellular target biomolecule, (ii) a carboxy-terminal, endoplasmic reticulum retention/retrieval signal motif of a member of the KDEL family, (iii) a polypeptide component, and (iv) a Shiga toxin effector polypeptide; wherein the amino-terminus of the Shiga toxin effector polypeptide is at and/or proximal to an amino-terminus of a polypeptide component of the cell-targeting molecule. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. In certain further embodiments, the binding region is not located proximally to an amino-terminus of the cell-targeting molecule relative to the Shiga toxin effector polypeptide.

For certain further embodiments, the Shiga toxin effector polypeptide is capable of exhibiting at least one Shiga toxin effector function, such as, e.g., directing intracellular routing to the endoplasmic reticulum and/or cytosol of a cell in which the polypeptide is present, inhibiting a ribosome function, enzymatically inactivating a ribosome, causing cytostasis, and/or causing cytotoxicity. In certain further embodiments, the cell-targeting molecule of the present invention is capable of one or more the following: entering a cell, inhibiting a ribosome function, causing cytostasis, and/or causing cell death.

In certain embodiments of Embodiment Set #11, the carboxy-terminal endoplasmic reticulum retention/retrieval signal motif is selected from the group consisting of: KDEL (SEQ ID NO: 514), HDEF (SEQ ID NO: 561), HDEL (SEQ ID NO: 515), RDEF (SEQ ID NO: 562), RDEL (SEQ ID NO: 516), WDEL (SEQ ID NO: 517), YDEL (SEQ ID NO: 518), HEEF (SEQ ID NO: 563), HEEL (SEQ ID NO: 519), KEEL (SEQ ID NO: 520), REEL (SEQ ID NO: 521), KAEL (SEQ ID NO: 564), KCEL (SEQ ID NO: 565), KFEL (SEQ ID NO: 522), KGEL (SEQ ID NO: 566), KHEL (SEQ ID NO: 567), KLEL (SEQ ID NO: 568), KNEL (SEQ ID NO: 569), KQEL (SEQ ID NO: 570), KREL (SEQ ID NO: 571), KSEL (SEQ ID NO: 572), KVEL (SEQ ID NO: 573), KWEL (SEQ ID NO: 574), KYEL (SEQ ID NO: 575), KEDL (SEQ ID NO: 576), KIEL (SEQ ID NO: 523), DKEL (SEQ ID NO: 524), FDEL (SEQ ID NO: 577), KDEF (SEQ ID NO: 578), KKEL (SEQ ID NO: 525), HADL (SEQ ID NO: 579), HAEL (SEQ ID NO: 580), HIEL (SEQ ID NO: 581), HNEL (SEQ ID NO: 526), HTEL (SEQ ID NO: 527), KTEL (SEQ ID NO: 528), HVEL (SEQ ID NO: 529), NDEL (SEQ ID NO: 582), QDEL (SEQ ID NO: 583), REDL (SEQ ID NO: 584), RNEL (SEQ ID NO: 585), RTDL (SEQ ID NO: 586), RTEL (SEQ ID NO: 587), SDEL (SEQ ID NO: 588), TDEL (SEQ ID NO: 589), SKEL (SEQ ID NO: 590), STEL (SEQ ID NO: 591), and EDEL (SEQ ID NO: 592).

In certain embodiments of Embodiment Set #11, the cell-targeting molecule of the present invention is capable when introduced to cells of exhibiting cytotoxicity that is greater than that of a twentieth cell-targeting molecule having an amino-terminus and comprising the binding region and the Shiga toxin effector polypeptide region which is not positioned at or proximal to the amino-terminus of the twentieth cell-targeting molecule and/or greater than that of a twenty-first cell-targeting molecule consisting of the cell-targeting molecule except for it does not comprise any carboxy-terminal, endoplasmic reticulum retention/retrieval signal motif of the KDEL family. In certain further embodiments, the twentieth cell-targeting molecule does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to a reference molecule, such as, e.g., the twentieth and/or twenty-first cell-targeting molecules. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the twentieth and/or twenty-first cell-targeting molecules to a second population of target positive cells as assayed by $CD_{50}$ values.

For certain further embodiments of Embodiment Set #11, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., the twentieth and/or twenty-first cell-targeting molecules.

Further Embodiments of Embodiment Sets #1-#11

In certain embodiments of Embodiment Sets #2 to #11, the Shiga toxin effector polypeptide is fused to the binding region, either directly or indirectly, such as, e.g., via a linker known to the skilled worker.

In certain embodiments of Embodiment Sets #2 to #11, the cell-targeting molecule comprises a molecular moiety located carboxy-terminal to the carboxy-terminus of the Shiga toxin A1 fragment region.

In certain embodiments of Embodiment Sets #2 to #11, the Shiga toxin effector polypeptide has a Shiga toxin A1 fragment derived region having a carboxy terminus and further comprises a disrupted furin-cleavage motif at the carboxy-terminus of the A1 fragment region.

In certain embodiments of Embodiment Sets #2 to #11, the cell-targeting molecule of the present invention, or a polypeptide component thereof, comprises a carboxy-terminal, endoplasmic reticulum retention/retrieval signal motif of a member of the KDEL family. For certain further embodiments, the carboxy-terminal endoplasmic reticulum retention/retrieval signal motif is selected from the group consisting of: KDEL (SEQ ID NO: 514), HDEF (SEQ ID NO: 561), HDEL (SEQ ID NO: 515), RDEF (SEQ ID NO: 562), RDEL (SEQ ID NO: 516), WDEL (SEQ ID NO: 517), YDEL (SEQ ID NO: 518), HEEF (SEQ ID NO: 563), HEEL (SEQ ID NO: 519), KEEL (SEQ ID NO: 520), REEL (SEQ ID NO: 521), KAEL (SEQ ID NO: 564), KCEL (SEQ ID NO: 565), KFEL (SEQ ID NO: 522), KGEL (SEQ ID NO: 566), KHEL (SEQ ID NO: 567), KLEL (SEQ ID NO: 568), KNEL (SEQ ID NO: 569), KQEL (SEQ ID NO: 571), KREL (SEQ ID NO: 571), KSEL (SEQ ID NO: 572), KVEL (SEQ ID NO: 573), KWEL (SEQ ID NO: 574), KYEL (SEQ ID NO: 575), KEDL (SEQ ID NO: 576), KIEL (SEQ ID NO: 523), DKEL (SEQ ID NO: 524), FDEL (SEQ ID NO: 577), KDEF (SEQ ID NO: 578), KKEL (SEQ ID NO: 525), HADL (SEQ ID NO: 579), HAEL (SEQ ID NO: 580), HIEL (SEQ ID NO: 581), HNEL (SEQ ID NO: 526), HTEL (SEQ ID NO: 527), KTEL (SEQ ID NO: 528), HVEL (SEQ ID NO: 529), NDEL (SEQ ID NO: 582), QDEL (SEQ ID NO: 583), REDL (SEQ ID NO: 584), RNEL (SEQ ID NO: 585), RTDL (SEQ ID NO: 586), RTEL (SEQ ID NO: 587), SDEL (SEQ ID NO: 588), TDEL (SEQ ID NO: 589), SKEL (SEQ ID NO: 590), STEL (SEQ ID NO: 591), and EDEL (SEQ ID NO: 592). In certain further embodiments, the cell-targeting molecule of the present invention is capable when introduced to cells of exhibiting cytotoxicity that is greater than that of a reference molecule, such as, e.g., a twenty-second cell-targeting molecule consisting of the cell-targeting molecule except for it does not comprise any carboxy-terminal, endoplasmic reticulum retention/retrieval signal motif of the KDEL family. In certain further embodiments, the cell-targeting molecule of the present invention is capable of exhibiting a cytotoxicity with better optimized, cytotoxic potency, such as, e.g., 4-fold, 5-fold, 6-fold, 9-fold, or greater cytotoxicity as compared to a reference molecule, such as, e.g., the twenty-second cell-targeting molecule. In certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the twenty-second cell-targeting molecule to a second population of target positive cells as assayed by $CD_{50}$ values.

In certain embodiments of Embodiment Sets #2 to #11, the Shiga toxin effector polypeptide further comprises at least one inserted or embedded, heterologous epitope.

In certain embodiments of Embodiment Sets #2 to #11, the Shiga toxin effector polypeptide further comprises at least one, two, or three disrupted, endogenous, B-cell and/or CD4+ T-cell epitope regions. In certain further embodiments, the Shiga toxin effector polypeptide comprises a disruption of at least one, two, or three endogenous, B-cell and/or T-cell epitopes and/or epitope regions. In certain further embodiments, the Shiga toxin effector polypeptide further comprises at least one disrupted, endogenous, B-cell and/or CD4+ T-cell epitope region which does not overlap with at least one inserted or embedded, heterologous epitope.

In certain embodiments of Embodiment Sets #2 to #11, the amino-terminus of the Shiga toxin effector polypeptide is at and/or proximal to an amino-terminus of a polypeptide component of the cell-targeting molecule. In certain further embodiments, the binding region is not located proximally to the amino-terminus of the cell-targeting molecule relative to the Shiga toxin effector polypeptide. In certain further embodiments, the binding region and Shiga toxin effector polypeptide are physically arranged or oriented within the cell-targeting molecule such that the binding region is not located proximally to the amino-terminus of the Shiga toxin effector polypeptide. In certain further embodiments, the binding region is located within the cell-targeting molecule more proximal to the carboxy-terminus of the Shiga toxin effector polypeptide than to the amino-terminus of the Shiga toxin effector polypeptide. For certain further embodiments, the cell-targeting molecule of the present invention is not cytotoxic and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., a twenty-third cell-targeting molecule having an amino-terminus and comprising the binding region and the Shiga toxin effector polypeptide which is not positioned at or proximal to the amino-terminus of the third cell-targeting molecule. For certain further embodiments, the cell-targeting molecule of the present invention exhibits cytotoxicity with better optimized, cytotoxic potency, such as, e.g., 4-fold, 5-fold, 6-fold, 9-fold, or greater cytotoxicity as compared to the cytotoxicity of the twenty-third cell-targeting molecule. For certain further embodiments, the cytotoxicity of the cell-targeting molecule of the present invention to a population of target positive cells is 3-fold, 4-fold, 5-fold, 6-fold, 7-fold, 8-fold, 9-fold, 10-fold or greater than the cytotoxicity of the twenty-third cell-targeting molecule to a second population of target positive cells as assayed by $CD_{50}$ values. In certain further embodiments, the twenty-third cell-targeting molecule does not comprise any carboxy-terminal, endoplasmic reticulum retention/retrieval signal motif of the KDEL family.

In certain embodiments of Embodiment Sets #2 to #11, the Shiga toxin effector polypeptide further comprises a disruption in the B-cell and/or T-cell epitope region selected from the group of natively positioned Shiga toxin A Subunit regions consisting of: 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2, and 210-218 of SEQ ID NO:3; 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; 285-293 of SEQ ID NO:1 or SEQ ID NO:2; 4-33 of SEQ ID NO:1 or SEQ ID NO:2; 34-78 of SEQ ID NO:1 or SEQ ID NO:2; 77-103 of SEQ ID NO:1 or SEQ ID NO:2; 128-168 of SEQ ID NO:1 or SEQ ID NO:2; 160-183 of SEQ ID NO:1 or SEQ ID NO:2; 236-258 of SEQ ID NO:1 or SEQ ID NO:2; and 274-293 of SEQ ID NO:1 or SEQ ID NO:2; or the equivalent region in a Shiga toxin A Subunit or derivative thereof. In certain further embodiments, there is no disruption which is a carboxy-terminal truncation of amino acid residues that overlap with part or all of at least one disrupted, endogenous, B-cell and/or T-cell epitope and/or epitope region.

In certain embodiments of Embodiment Sets #2 to #11, the Shiga toxin effector polypeptide further comprises a mutation, relative to a wild-type Shiga toxin A Subunit, in the B-cell immunogenic, amino acid residue selected from the group of natively positioned Shiga toxin A Subunit amino acid residues: L49, D197, D198, R204, and R205.

In certain embodiments of Embodiment Sets #2 to #11, the embedded or inserted, heterologous, T-cell epitope disrupts the endogenous, B-cell and/or T-cell epitope region is selected from the group of natively positioned Shiga toxin A Subunit regions consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3; or the equivalent region in a Shiga toxin A Subunit or derivative thereof, wherein there is no disruption which is an amino-terminal truncation of sequences that overlap with part or all of at least one disrupted epitope region; (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; or the equivalent region in a Shiga toxin A Subunit or derivative thereof.

In certain embodiments of Embodiment Sets #2 to #11, the Shiga toxin effector polypeptide comprises a mutation, relative to a wild-type Shiga toxin A Subunit, in the B-cell and/or T-cell epitope region selected from the group of natively positioned Shiga toxin A Subunit regions consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3; or the equivalent region in a Shiga toxin A Subunit or derivative thereof, wherein there is no disruption which is an amino-terminal truncation of sequences that overlap with part or all of at least one disrupted epitope region; (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; or the equivalent region in a Shiga toxin A Subunit or derivative thereof, wherein there is no disruption which is an amino-terminal truncation of sequences that overlap with part or all of at least one disrupted epitope region.

In certain embodiments of Embodiment Sets #2 to #11, the Shiga toxin effector polypeptide comprises a disruption of at least one endogenous epitope region selected from the group of natively positioned Shiga toxin A Subunits consisting of: 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; or 210-218 of SEQ ID NO:3.

In certain embodiments of Embodiment Sets #2 to #11, the Shiga toxin effector polypeptide does not comprise a heterologous, MHC class I-restricted, T-cell epitope. MHC class I-restricted, T-cell epitopes are known in the art or can be predicted by the skilled worker. The term heterologous refers to MHC class I-restricted, T-cell epitopes which are not natively present in wild-type Shiga toxin A Subunits, such as, e.g., the wild-type Shiga toxin A Subunit which is most closely related to the Shiga toxin effector polypeptide of interest.

In certain embodiments of Embodiment Sets #2 to #11, the Shiga toxin effector polypeptide comprises disruptions of at least four, five, six, seven, eight, or more endogenous, B-cell and/or T-cell epitope regions.

In certain embodiments of Embodiment Sets #2 to #11, one or more disruptions comprises an amino acid residue substitution relative to a wild-type Shiga toxin A Subunit.

In certain embodiments of Embodiment Sets #2 to #11, one or more endogenous, B-cell and/or T-cell epitope regions comprises a plurality of amino acid residue substitutions relative to a wild-type Shiga toxin A Subunit.

In certain embodiments of Embodiment Sets #2 to #11, at least one, two, three, or four disruptions comprise a plurality of amino acid residue substitutions in the endogenous, B-cell and/or T-cell epitope region relative to a wild-type Shiga toxin A Subunit.

In certain embodiments of Embodiment Sets #2 to #11, at least one disruption comprises at least one, two, three, four, five, six, seven, eight, or more amino acid residue substitutions relative to a wild-type Shiga toxin A Subunit, and optionally wherein at least one substitution occurs at the natively positioned Shiga toxin A Subunit amino acid residue selected form the group consisting of: 1 of SEQ ID NO:1 or SEQ ID NO:2; 4 of SEQ ID NO:1, SEQ ID NO:2, or SEQ ID NO:3; 6 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 12 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 44 of SEQ ID NO:1 or SEQ ID NO:2; 45 of SEQ ID NO:1 or SEQ ID NO:2; 46 of SEQ ID NO:1, SEQ ID NO:2, or SEQ ID NO:3; 47 of SEQ ID NO:1 or SEQ ID NO:2; 48 of SEQ ID NO:1, SEQ ID NO:2, or SEQ ID NO:3; 49 of SEQ ID NO:1, SEQ ID NO:2, or SEQ ID NO:3; 50 of SEQ ID NO:1 or SEQ ID NO:2; 51 of SEQ ID NO:1 or SEQ ID NO:2; 53 of SEQ ID NO:1 or SEQ ID NO:2; 54 of SEQ ID NO:1, SEQ ID NO:2, or SEQ ID NO:3; 55 of SEQ ID NO:1 or SEQ ID NO:2; 56 of SEQ ID NO:1, SEQ ID NO:2, or SEQ ID NO:3; 57 of SEQ ID NO:1, SEQ ID NO:2, or SEQ ID NO:3; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 84 of SEQ ID NO:1 or SEQ ID NO:2; 88 of SEQ ID NO:1, SEQ ID NO:2, or SEQ ID NO:3; 94 of SEQ ID NO:1, SEQ ID NO:2, or SEQ ID NO:3; 96 of SEQ ID NO:1, SEQ ID NO:2, or SEQ ID NO:3; 104 of SEQ ID NO:1 or SEQ ID NO:2; 105 of SEQ ID NO:1 or SEQ ID NO:2; 107 of SEQ ID NO:1, SEQ ID NO:2, or SEQ ID NO:3; 108 of SEQ ID NO:1 or SEQ ID NO:2; 109 of SEQ ID NO:1, SEQ ID NO:2, or SEQ ID NO:3; 110 of SEQ ID NO:1 or SEQ ID NO:2; 111 of SEQ ID NO:1, SEQ ID NO:2, or SEQ ID NO:3; 112 of SEQ ID NO:1, SEQ ID NO:2, or SEQ ID NO:3; 141 of SEQ ID NO:1, SEQ ID NO:2, or SEQ ID NO:3; 147 of SEQ ID NO:1, SEQ ID NO:2, or SEQ ID NO:3; 154 of SEQ ID NO:1 or SEQ ID NO:2; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 197 of SEQ ID NO:3; 198 of SEQ ID NO:1 or SEQ ID NO:2; 204 of SEQ ID NO:3; 205 of SEQ ID NO:1 or SEQ ID NO:2; 247 of SEQ ID NO:1 or SEQ ID NO:2; 247 of SEQ ID NO:3; 248 of SEQ ID NO:1 or SEQ ID NO:2; 250 of SEQ ID NO:3; 251 of SEQ ID NO:1 or SEQ ID NO:2; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2; or the equivalent amino acid residue in a Shiga toxin A Subunit or derivative thereof. In certain further embodiments, at least two disruptions each comprise at least one amino acid residue substitutions relative to a wild-type Shiga toxin A Subunit selected form the group consisting of: 1 of SEQ ID NO:1 or SEQ ID NO:2; 4 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 45 of SEQ ID NO:1 or SEQ ID NO:2; 47 of SEQ ID NO:1 or SEQ ID NO:2; 48 of SEQ ID NO:1, SEQ ID NO:2, or SEQ ID NO:3; 49 of SEQ ID NO:1 or SEQ ID NO:2; 53 of SEQ ID NO:1 or SEQ ID NO:2; 55 of SEQ ID NO:1 or SEQ ID NO:2; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 94 of SEQ ID NO:1, SEQ ID NO:2, or SEQ ID NO:3; 96 of SEQ ID NO:1, SEQ ID NO:2, or SEQ ID NO:3; 109 of SEQ ID NO:1, SEQ ID NO:2, or SEQ ID NO:3; 110 of SEQ ID NO:1 or SEQ ID NO:2; 112 of SEQ ID NO:1, SEQ ID NO:2, or SEQ ID NO:3; 147 of SEQ ID NO:1, SEQ ID NO:2, or SEQ ID NO:3; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 204 of SEQ ID NO:3; 205 of SEQ ID NO:1 or SEQ ID NO:2; 247 of SEQ ID NO:1 or SEQ ID NO:2; 247 of SEQ ID NO:3; 250 of SEQ ID NO:3; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2; or the equivalent amino acid residue in a Shiga toxin A Subunit or derivative thereof.

In certain embodiments of Embodiment Sets #2 to #11, the Shiga toxin effector polypeptide comprises disruption of at least three, endogenous, B-cell and/or T-cell epitope regions selected from the group of consisting of: (i) 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; and 53-66 of SEQ ID NO:1, SEQ ID NO:2, or SEQ ID NO:3, or the equivalent region in a Shiga toxin A Subunit or derivative thereof, wherein there is no disruption which is an amino-terminal truncation of amino acid residues that overlap with part or all of at least one disrupted, endogenous, B-cell and/or T-cell epitope region; (ii) 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; and 210-218 of SEQ ID NO:3; and (iii) 240-260 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2; or the equivalent region in a Shiga toxin A Subunit or derivative thereof, wherein there is no disruption which is a carboxy-terminal truncation of amino acid residues that overlap with part or all of at least one disrupted, endogenous, B-cell and/or T-cell epitope and/or epitope region.

In certain embodiments of Embodiment Sets #2 to #11, the Shiga toxin effector polypeptide comprises disruptions of at least two, endogenous, B-cell and/or T-cell epitope regions, wherein each disruption comprises one or more amino acid residue substitutions, and wherein the endogenous, B-cell and/or T-cell epitope regions are selected from the group of natively positioned Shiga toxin A Subunit regions consisting of: 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; or the equivalent region in a Shiga toxin A Subunit or derivative thereof.

In certain embodiments of Embodiment Sets #2 to #11, the embedded or inserted, heterologous, T-cell epitope does not disrupt any endogenous, B-cell and/or CD4+ T-cell epitope region described herein.

In certain embodiments of Embodiment Sets #2 to #11, at least one disruption comprises one or more amino acid residue substitutions relative to a wild-type Shiga toxin A Subunit is selected from the group consisting of: D to A, D to G, D to V, D to L, D to I, D to F, D to S, D to Q, D to M, D to R, E to A, E to G, E to V, E to L, E to I, E to F, E to S, E to Q, E to N, E to D, E to M, E to R, F to A, F to G, F to V, F to L, F to I, G to A, G to P, H to A, H to G, H to V, H to L, H to I, H to F, H to M, I to A, I to V, I to G, I to C, K to A, K to G, K to V, K to L, K to I, K to M, K to H, L to A, L to V, L to G, L to C, N to A, N to G, N to V, N to L, N to I, N to F, P to A, P to G, P to F, R to A, R to G, R to V, R to L, R to I, R to F, R to M, R to Q, R to S, R to K, R to H, S to A, S to G, S to V, S to L, S to I, S to F, S to M, T to A, T to G, T to V, T to L, T to I, T to F, T to M, T to S, V to A, V to G, Y to A, Y to G, Y to V, Y to L, Y to I, Y to F, Y to M, and Y to T. In certain further embodiments, the one or more amino acid residue substitutions relative to a wild-type Shiga toxin A Subunit is selected from the group consisting of D to A, D to G, D to V, D to L, D to I, D to F, D to S, D to Q, E to A, E to G, E to V, E to L, E to I, E to F, E to S, E to Q, E to N, E to D, E to M, E to R, G to A, H to A, H to G, H to V, H to L, H to I, H to F, H to M, K to A, K to G, K to V, K to L, K to I, K to M, K to H, L to A, L to G, N to A, N to G, N to V, N to L, N to I, N to F, P to A, P to G, P to F, R to A, R to G, R to V, R to L, R to I, R to F, R to M, R to Q, R to S, R to K, R to H, S to A, S to G, S to V, S to L, S to I, S to F, S to M, T to A, T to G, T to V, T to L, T to I, T to F, T to M, T to S, Y to A, Y to G, Y to V, Y to L, Y to I, Y to F, and Y to M.

In certain embodiments of Embodiment Sets #2 to #11, at least one of the disruption(s) comprises one or more amino acid residue substitutions relative to a wild-type Shiga toxin A Subunit selected from the group consisting of: K1 to A, G, V, L, I, F, M and H; T4 to A, G, V, L, I, F, M, and S; D6 to A, G, V, L, I, F, S, Q and R; S8 to A, G, V, I, L, F, and M; T9 to A, G, V, I, L, F, M, and S; S9 to A, G, V, L, I, F, and M; K11 to A, G, V, L, I, F, M and H; T12 to A, G, V, I, L, F, M, S, and K; S12 to A, G, V, I, L, F, and M; S33 to A, G, V, L, I, F, M, and C; S43 to A, G, V, L, I, F, and M; G44 to A or L; S45 to A, G, V, L, I, F, and M; T45 to A, G, V, L, I, F, and M; G46 to A and P; D47 to A, G, V, L, I, F, S, M, and Q; N48 to A, G, V, L, M and F; L49 to A, V, C, and G; Y49 to A, G, V, L, I, F, M, and T; F50 to A, G, V, L, I, and T; A51; D53 to A, G, V, L, I, F, S, and Q; V54 to A, G, I, and L; R55 to A, G, V, L, I, F, M, Q, S, K, and H; G56 to A and P; 157 to A, G, V, and M; L57 to A, V, C, G, M, and F; D58 to A, G, V, L, I, F, S, and Q; P59 to A, G, and F; E60 to A, G, V, L, I, F, S, Q, N, D, M, T, and R; E61 to A, G, V, L, I, F, S, Q, N, D, M, and R; G62 to A; R84 to A, G, V, L, I, F, M, Q, S, K, and H; V88 to A and G; 188 to A, V, C, and G; D94 to A, G, V, L, I, F, S, and Q; S96 to A, G, V, I, L, F, and M; T104 to A, G, V, L, I, F, M; and N; A105 to L; T107 to A, G, V, L, I, F, M, and P; S107 to A, G, V, L, I, F, M, and P; L108 to A, V, C, and G; S109 to A, G, V, I, L, F, and M; T109 to A, G, V, I, L, F, M, and S; G110 to A; S112 to A, G, V, L, I, F, and M; D111 to A, G, V, L, I, F, S, Q, and T; S112 to A, G, V, L, I, F, and M; D141 to A, G, V, L, I, F, S, and Q; G147 to A; V154 to A and G. R179 to A, G, V, L, I, F, M, Q, S, K, and H; T180 to A, G, V, L, I, F, M, and S; T181 to A, G, V, L, I, F, M, and S; D183 to A, G, V, L, I, F, S, and Q; D184 to A, G, V, L, I, F, S, and Q; L185 to A, G, V and C; S186 to A, G, V, I, L, F, and M; G187 to A; R188 to A, G, V, L, I, F, M, Q, S, K, and H; S189 to A, G, V, I, L, F, and M; D197 to A, G, V, L, I, F, S, and Q; D198 to A, G, V, L, I, F, S, and Q; R204 to A, G, V, L, I, F, M, Q, S, K, and H; R205 to A, G, V, L, I, F, M, Q, S, K and H; S247 to A, G, V, I, L, F, and M; Y247 to A, G, V, L, I, F, and M; R248 to A, G, V, L, I, F, M, Q, S, K, and H; R250 to A, G, V, L, I, F, M, Q, S, K, and H; R251 to A, G, V, L, I, F, M, Q, S, K, and H; D264 to A, G, V, L, I, F, S, and Q; G264 to A; and T286 to A, G, V, L, I, F, M, and S.

For certain embodiments of Embodiment Sets #2 to #11, the cell-targeting molecule of the present invention is capable when introduced to a chordate of exhibiting improved in vivo tolerability and/or stability compared to a reference molecule, such as, e.g., a twenty-fourth cell-targeting molecule consisting of the cell-targeting molecule except for all of its Shiga toxin effector polypeptide component(s) each comprise a wild-type Shiga toxin A1 fragment and/or wild-type Shiga toxin furin-cleavage site at the carboxy terminus of its A1 fragment region. In certain further embodiments, the Shiga toxin effector polypeptide is not cytotoxic and the molecular moiety is cytotoxic.

In certain embodiments of Embodiment Sets #2 to #11, the binding region and Shiga toxin effector polypeptide are linked together, either directly or indirectly.

In certain embodiments of Embodiment Sets #2 to #11, the binding region comprises at least one peptide and/or polypeptide. In certain further embodiments, the binding region is or comprises an immunoglobulin-type binding region. In certain further embodiments, the binding region comprising a polypeptide selected from the group consisting of: an autonomous $V_H$ domain, single-domain antibody fragment (sdAb), nanobody, heavy chain-antibody domain derived from a camelid ($V_HH$ or $V_H$ domain fragment), heavy-chain antibody domain derived from a cartilaginous fish ($V_HH$ or $V_H$ domain fragment), immunoglobulin new antigen receptor (IgNAR), $V_{NAR}$ fragment, single-chain variable fragment (scFv), antibody variable fragment (Fv), complementary determining region 3 fragment (CDR3), constrained FR3-CDR3-FR4 polypeptide (FR3-CDR3-FR4), Fd fragment, small modular immunopharmaceutical (SMIP) domain, antigen-binding fragment (Fab), Armadillo repeat polypeptide (ArmRP), fibronectin-derived $10^{th}$ fibronectin type III domain (10Fn3), tenascin type III domain (TNfn3), ankyrin repeat motif domain, low-density-lipoprotein-receptor-derived A-domain (LDLR-A), lipocalin (anticalin), Kunitz domain, Protein-A-derived Z domain, gamma-B crystalline-derived domain, ubiquitin-derived domain, Sac7d-derived polypeptide (affitin), Fyn-derived SH2 domain, miniprotein, C-type lectin-like domain scaffold, engineered antibody mimic, and any genetically manipulated counterparts of any of the foregoing which retain binding functionality.

For certain embodiments of Embodiment Sets #2 to #11, the cell-targeting molecule of the present invention is capable of exhibiting (i) a catalytic activity level comparable to a wild-type Shiga toxin A1 fragment or wild-type Shiga toxin effector polypeptide, (ii) a ribosome inhibition activity with a half-maximal inhibitory concentration ($IC_{50}$) value of 10,000 picomolar or less, and/or (iii) a significant level of Shiga toxin catalytic activity.

For certain embodiments of Embodiment Sets #2 to #11, the cell-targeting molecule of the present invention and/or its Shiga toxin effector polypeptide is capable of exhibiting subcellular routing efficiency comparable to a reference cell-targeting molecule comprising a wild-type Shiga toxin A1 fragment or wild-type Shiga toxin effector polypeptide and/or capable of exhibiting a significant level of intracellular routing activity to the endoplasmic reticulum and/or cytosol from an endosomal starting location of a cell.

For certain embodiments of Embodiment Sets #2 to #11, whereby administration of the cell-targeting molecule of the present invention to a cell physically coupled with the extracellular target biomolecule of the cell-targeting molecule's binding region, the cell-targeting molecule is capable of causing death of the cell. In certain further embodiments, administration of the cell-targeting molecule of the invention to two different populations of cell types which differ with respect to the presence or level of the extracellular target biomolecule, the cell-targeting molecule is capable of causing cell death to the cell-types physically coupled with an extracellular target biomolecule of the cytotoxic cell-targeting molecule's binding region at a $CD_{50}$ at least three times or less than the $CD_{50}$ to cell types which are not physically coupled with an extracellular target biomolecule of the cell-targeting molecule's binding region. For certain embodiments, whereby administration of the cell-targeting molecule of the present invention to a first populations of cells whose members are physically coupled to extracellular target biomolecules of the cell-targeting molecule's binding region, and a second population of cells whose members are not physically coupled to any extracellular target biomolecule of the binding region, the cytotoxic effect of the cell-targeting molecule to members of said first population of cells relative to members of said second population of cells is at least 3-fold greater. For certain embodiments, whereby administration of the cell-targeting molecule of the present invention to a first populations of cells whose members are physically coupled to a significant amount of the extracellular target biomolecule of the cell-targeting molecule's binding region, and a second population of cells whose members are not physically coupled to a significant amount of any extracellular target biomolecule of the binding region, the cytotoxic effect of the cell-targeting molecule to members of said first population of cells relative to members of said second population of cells is at least 3-fold greater. For certain embodiments, whereby administration of the cell-targeting molecule of the present invention to a first population of target biomolecule positive cells, and a second population of cells whose members do not express a significant amount of a target biomolecule of the cell-targeting molecule's binding region at a cellular surface, the cytotoxic effect of the cell-targeting molecule to members of the first population of cells relative to members of the second population of cells is at least 3-fold greater.

For certain embodiments of Embodiment Sets #2 to #11, the cell-targeting molecule of the present invention is capable when introduced to cells of exhibiting a cytotoxicity with a half-maximal inhibitory concentration ($CD_{50}$) value of 300 nM or less and/or capable of exhibiting a significant level of Shiga toxin cytotoxicity.

For certain embodiments of Embodiment Sets #2 to #11, the cell-targeting molecule of the present invention is capable of delivering an embedded or inserted, heterologous, CD8+ T-cell epitope to a MHC class I presentation pathway of a cell for cell-surface presentation of the epitope bound by a MHC class I molecule.

In certain embodiments of Embodiment Sets #2 to #11, the cell-targeting molecule comprises a molecular moiety associated with the carboxy-terminus of the Shiga toxin effector polypeptide. In certain embodiments, the molecular moiety comprises or consists of the binding region. In certain embodiments, the molecular moiety comprises at least one amino acid and the Shiga toxin effector polypeptide is linked to at least one amino acid residue of the molecular moiety. In certain further embodiments, the molecular moiety and the Shiga toxin effector polypeptide are fused forming a continuous polypeptide.

In certain embodiments of Embodiment Sets #2 to #11, the cell-targeting molecule further comprises a cytotoxic molecular moiety associated with the carboxy-terminus of the Shiga toxin effector polypeptide. For certain embodiments, the cytotoxic molecular moiety is a cytotoxic agent, such as, e.g., a small molecule chemotherapeutic agent, anti-neoplastic agent, cytotoxic antibiotic, alkylating agent, antimetabolite, topoisomerase inhibitor, and/or tubulin inhibitor known to the skilled worker and/or described herein. For certain further embodiments, the cytotoxic molecular moiety is cytotoxic at concentrations of less than 10,000, 5,000, 1,000, 500, or 200 pM.

In certain embodiments of Embodiment Sets #2 to #11, the binding region is capable of binding to an extracellular target biomolecule selected from the group consisting of: CD20, CD22, CD40, CD74, CD79, CD25, CD30, HER2/neu/ErbB2, EGFR, EpCAM, EphB2, prostate-specific membrane antigen, Cripto, CDCP1, endoglin, fibroblast activated protein, Lewis-Y, CD19, CD21, CS1/SLAMF7, CD33, CD52, CD133, CEA, gpA33, mucin, TAG-72, tyrosine-protein kinase transmembrane receptor (ROR1 or NTRKR1), carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, c-MET, IGF1R, EphA3, TRAIL-R1, TRAIL-R2, RANK, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, HPV-E7, Epstein-Barr virus antigen, Bcr-Abl, alpha-fetoprotein antigen, 17-A1, bladder tumor antigen, CD38, CD15, CD23, CD45 (protein tyrosine phosphatase receptor type C), CD53, CD88, CD129, CD183, CD191, CD193, CD244, CD294, CD305, C3AR, FceRIa, galectin-9, IL-1R (interleukin-1 receptor), mrp-14, NKG2D ligand, programmed death-ligand 1 (PD-L1), Siglec-8, Siglec-10, CD49d, CD13, CD44, CD54, CD63, CD69, CD123, TLR4, FceRIa, IgE, CD107a, CD203c, CD14, CD68, CD80, CD86, CD105, CD115, F4/80, ILT-3, galectin-3, CD11a-c, GITRL, MHC class I molecule, MHC class II molecule (optionally complexed with a peptide), CD284 (TLR4), CD107-Mac3, CD195 (CCR5), HLA-DR, CD16/32, CD282 (TLR2), CD11c, and any immunogenic fragment of any of the foregoing.

In certain embodiments of Embodiment Sets #2 to #11, the binding region is linked, either directly or indirectly, to the Shiga toxin effector polypeptide by at least one covalent bond which is not a disulfide bond. In certain further embodiments, the binding region is fused, either directly or indirectly, to the carboxy-terminus of the Shiga toxin effector polypeptide to form a single, continuous polypeptide. In certain further embodiments, the binding region is an immunoglobulin-type binding region.

In certain embodiments of Embodiment Sets #2 to #11, the disrupted furin-cleavage motif comprises one or more mutations in the minimal, furin-cleavage site relative to a wild-type Shiga toxin A Subunit. In certain embodiments, the disrupted furin-cleavage motif is not an amino-terminal truncation of sequences that overlap with part or all of at least one amino acid residue of the minimal furin-cleavage site. In certain embodiments, the mutation in the minimal, furin-cleavage site is an amino acid deletion, insertion, and/or substitution of at least one amino acid residue in the R/Y-x-x-R furin cleavage motif. In certain further embodiments, the disrupted furin-cleavage motif comprises at least one mutation relative to a wild-type Shiga toxin A Subunit, the mutation altering at least one amino acid residue in the region natively positioned 1) at 248-251 of the A Subunit of Shiga-like toxin 1 (SEQ ID NO: 1) or Shiga toxin (SEQ ID NO: 2), or 2) at 247-250 of the A Subunit of Shiga-like toxin 2 (SEQ ID NO:3), or the equivalent amino acid sequence position in any Shiga toxin A Subunit. In certain further embodiments, the mutation is an amino acid residue substitution of an arginine residue with a non-positively charged, amino acid residue.

In certain embodiments of Embodiment Sets #2 to #11, the cell-targeting molecule of the present invention is capable when introduced to cells of exhibiting cytotoxicity comparable to a cytotoxicity of a reference molecule, such as, e.g., a twenty-fifth cell-targeting molecule consisting of the cell-targeting molecule except for all of its Shiga toxin effector polypeptide component(s) each comprise a wild-type Shiga toxin A1 fragment.

In certain embodiments of Embodiment Sets #2 to #11, the binding region comprises the peptide or polypeptide shown in any one of SEQ ID NOs: 83-339. In certain further embodiments, the binding region comprises or consists essentially of the polypeptide represented by any of the following: amino acids 1-245 of any one of SEQ ID NOs: 33, 64, and 65; 269-513 of SEQ ID NO:40 or SEQ ID NO:80; amino acids 269-520 or 269-521 of any one of SEQ ID NOs: 36, 66, and 67; amino acids 1-232, 1-233, 1-234, 1-235, 1-236, 1-242, 1-243, 1-244, 1-245, 1-246, 1-252, 1-253, 1-254, 1-255, or 1-256 of any one of SEQ ID NOs: 47-119 and 176-248; amino acids 269-498 or 269-499 of any one of SEQ ID NOs: 37-39, 68-79, and 81; amino acids 269-499, 269-512, 269-513, or 280-510 of any one of SEQ ID NOs: 34, 35, 41-56, and 82.

In certain embodiments of Embodiment Sets #2 to #11, the binding region sterically covers the carboxy-terminus of the A1 fragment region.

In certain embodiments of Embodiment Sets #2 to #11, the molecular moiety sterically covers the carboxy-terminus of the A1 fragment region. In certain further embodiments, the molecular moiety comprises the binding region.

In certain embodiments of Embodiment Sets #2 to #11, the cell-targeting molecule of the present invention comprises a binding region and/or molecular moiety located carboxy-terminal to the carboxy-terminus of the Shiga toxin A1 fragment region. In certain further embodiments, the mass of the binding region and/or molecular moiety is at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater.

In certain embodiments of Embodiment Sets #2 to #11, the cell-targeting molecule comprises a binding region with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein (e.g., cytotoxicity and/or intracellular routing).

In certain embodiments of Embodiment Sets #2 to #11, the binding region is comprised within a relatively large, molecular moiety comprising such as, e.g., a molecular moiety with a mass of at least 4.5 kDa, 6, kDa, 9 kDa, 12 kDa, 15 kDa, 20 kDa, 25 kDa, 28 kDa, 30 kDa, 41 kDa, 50 kDa, 100 kDa, or greater, as long as the cell-targeting molecule retains the appropriate level of the Shiga toxin biological activity noted herein.

For certain embodiments of Embodiment Sets #2 to #11, the cell-targeting molecule of the present invention exhibits low cytotoxic potency (i.e. is not capable when introduced to certain positive target cell types of exhibiting a cytotoxicity greater than 1% cell death of a cell population at a cell-targeting molecule concentration of 1000 nM, 500 nM, 100 nM, 75 nM, or 50 nM) and is capable when introduced to cells of exhibiting a greater subcellular routing efficiency from an extracellular space to a subcellular compartment of an endoplasmic reticulum and/or cytosol as compared to the cytotoxicity of a reference molecule, such as, e.g., a twenty-sixth cell-targeting molecule having an amino-terminus and comprising the binding region and the Shiga toxin effector polypeptide which is not positioned at or proximal to the amino-terminus of the third cell-targeting molecule. In certain further embodiments, the twenty-sixth cell-targeting molecule does not comprise any carboxy-terminal, endoplasmic reticulum retention/retrieval signal motif of the KDEL family.

In certain embodiments of Embodiment Sets #2 to #11, In certain further embodiments, the molecular moiety comprises a peptide and/or polypeptide derived from the Shiga toxin A2 fragment of a naturally occurring Shiga toxin.

The embodiments of the present invention are not intended to cover any naturally-occurring Shiga holotoxin or Shiga toxin A Subunit. In certain embodiments of Embodiment Sets #2-11, the cell-targeting molecule of the present invention does not comprise a naturally occurring Shiga toxin B Subunit. In certain further embodiments, the cell-targeting molecule of the invention does not comprise any polypeptide comprising or consisting essentially of a functional binding domain of a native Shiga toxin B subunit. Rather, in certain embodiments of the cell-targeting molecules of the invention, the Shiga toxin A Subunit derived regions are functionally associated with heterologous binding regions to effectuate cell-targeting.

In certain embodiments of Embodiment Sets #2 to #11, the binding region does not comprise a fragment of human CD4 corresponding to amino acid residues 19-183. In certain further embodiments, the binding region does not comprise a fragment of human CD4, a type-I transmembrane glycoprotein. In certain further embodiments, the binding region does not comprise a fragment of a human, immune cell surface co-receptor.

In certain embodiments of Embodiment Sets #2 to #11, the cell-targeting molecule of the present invention does not comprise a carboxy-terminal, binding region comprising a fragment of an immune cell surface receptor.

In certain embodiments of Embodiment Sets #1 to #11, the Shiga toxin effector polypeptide comprises at least two, embedded or inserted, heterologous epitopes.

In certain embodiments of Embodiment Sets #1 to #11, the Shiga toxin effector polypeptide does not comprise the set of amino acid residue substitutions relative to a wild-type Shiga toxin A Subunit selected from the following sets: (1) R248H and R251H; (2) R248G and R251G; (3) A246G, S247A, A253G, and S254A; and (4) A246G, S247A, R248G, R251G, A253G, and S254A.

In certain embodiments of Embodiment Sets #1 to #11, the Shiga toxin effector polypeptide does not comprise a deletion of the region natively positioned at 247-252 in a wild-type Shiga toxin A Subunit. In certain embodiments of Embodiment Sets #2-11, the Shiga toxin effector polypeptide does not comprise deletions of the regions natively positioned at 245-247 and 253-255 in a wild-type Shiga toxin A Subunit.

In certain embodiments of Embodiment Sets #1 to #11, the Shiga toxin effector polypeptide comprises one or more mutations relative to a naturally occurring A Subunit of a member of the Shiga toxin family which changes an enzymatic activity of the Shiga toxin effector polypeptide, the mutation selected from at least one amino acid residue deletion, insertion, or substitution. In certain further embodiments, the mutation relative to the naturally occurring A Subunit reduces of eliminates a cytotoxic activity of the Shiga toxin effector polypeptide but the Shiga toxin effector polypeptide retains at least one other Shiga toxin effector function, such as, e.g., promoting cellular internalization and/or directing intracellular routing to a certain subcellular compartment(s). In certain further embodiments, the mutation relative to the naturally occurring A Subunit is selected from at least one amino acid residue substitution, such as, e.g., A231E, R75A, Y77S, Y114S, E167D, R170A, R176K, and/or W203A in SEQ ID NO:1, SEQ ID NO:2, or SEQ ID NO:3.

For certain embodiments of Embodiment Sets #1 to #11, the Shiga toxin effector polypeptide is capable of: (i) routing to a subcellular compartment of a cell in which the Shiga toxin effector polypeptide is present selected from the following: cytosol, endoplasmic reticulum, and lysosome; (ii) intracellular delivery of the epitope from an early endosomal compartment to a proteasome of a cell in which the Shiga toxin effector polypeptide is present; and/or (iii) intracellular delivery of the epitope to a MHC class I molecule from an early endosomal compartment of a cell in which the Shiga toxin effector polypeptide is present. In certain further embodiments, the Shiga toxin effector polypeptide is capable of intracellular delivery of the CD 8+ T-cell epitope for presentation by a MHC class I molecule on the surface of a cell in which the Shiga toxin effector polypeptide is present.

In certain embodiments, the molecule of the present invention does not comprise, at a position carboxy-terminal of the Shiga toxin effector polypeptide and/or the carboxy-terminus of the Shiga toxin A1 fragment region, any additional exogenous material representing an antigen and/or heterologous, CD8+, T-cell epitope-peptide.

In certain embodiments of Embodiment Sets #2 to #11, the binding region does not comprise a ligand. In certain embodiments of Embodiment Sets #2 to #11, the binding region does not comprise a chemokine or a TNF-related apoptosis-inducing ligand (TRAIL) nor a receptor binding fragment thereof. In certain embodiments of Embodiment Sets #2 to #11, the binding region does not comprise a human chemokine or human TRAIL nor a receptor binding fragment thereof. In embodiments of Embodiment Sets #2 to #11, the immunoglobulin-type binding region does not comprise a ligand nor a receptor binding fragment thereof. In certain embodiments of Embodiment Sets #2 to #11, the immunoglobulin-type binding region does not comprise a chemokine or a TNF-related apoptosis-inducing ligand (TRAIL) nor a receptor binding fragment thereof. In certain embodiments of Embodiment Sets #2 to #11, the binding region does not comprise a human CC chemokine nor a receptor binding fragment thereof. In certain embodiments of Embodiment Sets #2 to #11, the binding region does not comprise the human CC chemokine CCL2 (see Bose S, Cho J et al., *Arch Pharm Res* 36: 1039-50 (2013)). In certain embodiments of Embodiment Sets #2 to #11, the binding region does not comprise the human, CC chemokine CCL2, nor a receptor binding fragment thereof, and a carboxy-terminal, Shiga toxin effector polypeptide consisting of amino acids 75-247 of StxA. In certain embodiments of the cell-targeting molecule of the present invention, the binding region does not comprise the human, CC chemokine CCL2, nor a receptor binding fragment thereof, fused to a carboxy-terminal, Shiga toxin effector polypeptide consisting of amino acids 75-247 of StxA (SEQ ID NO:2). In embodiments of Embodiment Sets #2 to #11, the binding region does not comprise the human TRAIL nor a receptor binding fragment thereof.

Among certain embodiments of the present invention is a pharmaceutical composition comprising any one of the above Shiga toxin effector polypeptides of the present invention and/or any one of the above cell-targeting molecules of the present invention; and at least one pharmaceutically acceptable excipient or carrier.

Among certain embodiments of the present invention is a diagnostic composition comprising any one of the above cell-targeting molecules of the present invention and a detection promoting agent. Certain further embodiments are cell-targeting molecules of the present invention wherein the detection promoting agent is a heterologous epitope and the cell-targeting molecule comprises the heterologous epitope.

Beyond the Shiga toxin effector polypeptides of the present invention, cell-targeting molecules of the present invention, and compositions thereof, polynucleotides capable of encoding a Shiga toxin effector polypeptide or cell-targeting molecule of the present invention are within the scope of the present invention, as well as expression vectors which comprise a polynucleotide of the present invention and host cells comprising any polynucleotide and/or expression vector of the present invention. Host cells comprising an expression vector may be used, e.g., in methods for producing a molecule of the present invention or a polypeptide component or fragment thereof by recombinant expression.

Among certain embodiments of the present invention is a method of killing a cell comprising the step of contacting the cell with any of the above cell-targeting molecules of the present invention or the above pharmaceutical compositions of the present invention. In certain embodiments, the step of contacting the cell(s) occurs in vitro. In certain other embodiments, the step of contacting the cell(s) occurs or in vivo. In further embodiments of the cell-killing methods, the method is capable of selectively killing cell(s) and/or cell types preferentially over other cell(s) and/or cell types when contacting a mixture of cells which differ with respect to the extracellular presence and/or expression level of an extracellular target biomolecule of the binding region of the cell-targeting molecule.

The present invention further provides methods of treating diseases, disorders, and/or conditions in patients comprising the step of administering to a patient in need thereof a therapeutically effective amount of a cell-targeting molecule and/or pharmaceutical composition of the present invention. In certain embodiments, the disease, disorder, or condition to be treated using a method of the invention is selected from: a cancer, tumor, growth abnormality, immune disorder, or microbial infection. In certain embodiments of these methods, the cancer to be treated is selected from the group consisting of: bone cancer, breast cancer, central/peripheral nervous system cancer, gastrointestinal cancer, germ cell cancer, glandular cancer, head-neck cancer, hematological cancer, kidney-urinary tract cancer, liver cancer, lung/pleura cancer, prostate cancer, sarcoma, skin cancer, and uterine cancer. In certain embodiments of these methods, the immune disorder to be treated is an immune disorder associated with a disease selected from the group consisting of: amyloidosis, ankylosing spondylitis, asthma, Crohn's disease, diabetes, graft rejection, graft-versus-host disease, Hashimoto's thyroiditis, hemolytic uremic syndrome, HIV-related diseases, lupus erythematosus, multiple sclerosis, polyarteritis nodosa, polyarthritis, psoriasis, psoriatic arthritis, rheumatoid arthritis, scleroderma, septic shock, Sjörgren's syndrome, ulcerative colitis, and vasculitis.

The use of any composition of matter of the present invention for the treatment or prevention of a cancer, tumor, growth abnormality, and/or immune disorder is within the scope of the present invention. Among certain embodiments of the present invention is a cell-targeting molecule of the present invention and/or a pharmaceutical composition thereof for the treatment or prevention of a cancer, tumor, growth abnormality, immune disorder, and/or microbial infection. Among certain embodiments of the present invention is the use of a cell-targeting molecule of the present invention and/or pharmaceutical composition thereof in the manufacture of a medicament for the treatment or prevention of a cancer, tumor, growth abnormality, immune disorder, or microbial infection.

Certain embodiments of the cell-targeting molecules of the present invention may be utilized for the delivery of additional exogenous material into a cell physically coupled with an extracellular target biomolecule of the cell-targeting molecule of the invention. Additionally, the present invention provides a method for delivering exogenous material to the inside of a cell(s) comprising contacting the cell(s), either in vitro or in vivo, with a cell-targeting molecule, pharmaceutical composition, and/or diagnostic composition of the present invention. The present invention further provides a method for delivering exogenous material to the inside of a cell(s) in a patient, the method comprising the step of administering to the patient a cell-targeting molecule of the present invention (with or without cytotoxic activity), wherein the target cell(s) is physically coupled with an extracellular target biomolecule of the cell-targeting molecule.

Among certain embodiments of the present invention is a method of delivering into a cell a T-cell epitope capable of being presented by a MHC class I molecule of the cell, the method comprising the step of contacting the cell with the cell-targeting molecule of the present invention which is associated with a heterologous, T-cell epitope and/or a composition thereof (e.g., a pharmaceutical or diagnostic composition of the present invention).

Among certain embodiments of the present invention is a method for "seeding" a tissue locus within a chordate, the method comprising the step of: administering to the chordate a cell-targeting molecule of the present invention, a pharmaceutical composition of the present invention, and/or a diagnostic composition of the present invention. In certain further embodiments, the methods of the invention for "seeding" a tissue locus are for "seeding" a tissue locus which comprises a malignant, diseased, or inflamed tissue. In certain further embodiments, the methods of the invention for "seeding" a tissue locus are for "seeding" a tissue locus which comprises the tissue selected from the group consisting of: diseased tissue, tumor mass, cancerous growth, tumor, infected tissue, or abnormal cellular mass. In certain further embodiments, the methods of the invention for "seeding" a tissue locus comprises administering to the chordate the cell-targeting molecule of the invention, the pharmaceutical composition of the invention, or the diagnostic composition of the invention comprising the heterologous, T-cell epitope selected from the group consisting of: peptides not natively presented by the target cells of the cell-targeting molecule in MHC class I complexes, peptides not natively present within any protein expressed by the target cell, peptides not natively present within the proteome of the target cell, peptides not natively present in the extracellular microenvironment of the site to be seeded, and peptides not natively present in the tumor mass or infected tissue site to be targeted.

The use of any composition of matter of the present invention for the diagnosis, prognosis, and/or characterization of a disease, disorder, and/or condition is within the scope of the present invention. Among certain embodiments of the present invention is a method of using a cell-targeting molecule of the present invention comprising a detection promoting agent and/or composition of the invention (e.g. a diagnostic composition) for the collection of information useful in the diagnosis, prognosis, or characterization of a disease, disorder, or condition. Among certain embodiments of the present invention is the method of detecting a cell (or subcellular compartment thereof) using a cell-targeting molecule and/or diagnostic composition of the present invention, the method comprising the steps of contacting a cell with the cell-targeting molecule and/or diagnostic composition and detecting the presence of said cell-targeting molecule and/or diagnostic composition. In certain embodiments, the step of contacting the cell(s) occurs in vitro. In certain embodiments, the step of contacting the cell(s) occurs in vivo. In certain embodiments, the step of detecting the cell(s) occurs in vitro. In certain embodiments, the step of detecting the cell(s) occurs in vivo. In certain further embodiments, the method involves the detection of the location of the cell-targeting molecule in an organism using one or more imaging procedures after the administration of the cell-targeting molecule to said organism. For example, cell-targeting molecules of the invention which incorporate detection promoting agents as described herein may be used to characterize diseases as potentially treatable by a related pharmaceutical composition of the present invention. For example, certain cell-targeting molecules of the present invention and compositions thereof (e.g. pharmaceutical compositions and diagnostic compositions of the present invention), and methods of the present invention may be used to determine if a patient belongs to a group that responds to a pharmaceutical composition of the present invention. For example, certain cell-targeting molecules of the present invention and compositions thereof may be used to identify cells which present a delivered heterologous epitope-peptide on a cellular surface and/or to identify subjects containing cells which present a heterologous epitope-peptide delivered by a cell-targeting molecule of the present invention.

Among certain embodiments of the present invention is a method of producing a molecule of the present invention, the method comprising the step of purifying the molecule of the invention or a polypeptide component of thereof using a bacterial cell-wall protein domain interaction, such as, e.g., protein L from *P. magnus* or derivatives and binding domain fragments thereof. In certain further embodiments, the purifying step of the method involves the Shiga toxin effector polypeptide comprising or consisting essentially of any one of the polypeptides shown in SEQ ID NOs: 6-32 and 340-383. In certain further embodiments, the purifying step of the method involves the cell-targeting molecule comprising or consisting essentially of any one of the polypeptides shown in SEQ ID NOs: 43-82 and 439-513.

Certain embodiments of the Shiga toxin effector polypeptides of the present invention may be utilized as an immunogen or as a component of an immunogen for the immunization and/or vaccination of a chordate. Among certain embodiments of the present invention is a method of immunizing a chordate using a Shiga toxin effector polypeptide of the present invention, the method comprising administering a chordate the Shiga toxin effector polypeptide of the invention. In certain further embodiments, the Shiga toxin effector polypeptide comprises or consists essentially of any one of the polypeptides shown in SEQ ID NOs: 6-32 and 340-383.

Among certain embodiments of the present invention are kits comprising a composition of matter of the invention, and optionally, instructions for use, additional reagent(s), and/or pharmaceutical delivery device(s). The kit may further comprise reagents and other tools for detecting a cell type (e.g. a tumor cell) in a sample or in a subject.

These and other features, aspects and advantages of the present invention will become better understood with regard to the following description, appended claims, and accompanying figures. The aforementioned elements of the invention may be individually combined or removed freely in order to make other embodiments of the invention, without any statement to object to such synthesis or removal hereinafter.

BRIEF DESCRIPTION OF THE FIGURES

FIG. 2 graphically shows the protein synthesis inhibition activities of exemplary cell-targeting molecules of the present invention in vitro and over a range of concentrations. For each sample molecule, the luminescent intensity of luciferase expressed during the assay in relative luminescent units (RLU) was plotted over the logarithm to base 10 of the concentration of the cell-targeting molecule tested in picomolar. These exemplary cell-targeting molecules exhibited ribosome inhibition activities comparable to a "control" cell-targeting molecule, whose Shiga toxin effector polypeptide component consisted of a wild-type Shiga toxin A Subunit fragment except for it comprised a disrupted, furin-cleavage site at the carboxy-terminus of its Shiga toxin A1 fragment region (SLT-1A-FR (SEQ ID NO:5)). FIG. 2 shows that exemplary alterations to naturally occurring, Shiga toxin A Subunit polypeptides, such as, e.g., de-immunizing substitutions and embedded, heterologous, T-cell epitopes, did not significantly impair Shiga toxin catalytic activity.

FIGS. 3-7 and 9-10 graphically show that exemplary cell-targeting molecules of the present invention SLT-1A-combo (n)::scFv-(n) exhibited cell-targeted cytotoxicity comparable to "control" cell-targeting molecules SLT-1A-FR::scFv-(n), whose Shiga toxin effector polypeptide component consisted of a wild-type Shiga toxin A Subunit fragment except for it comprised a disrupted, furin-cleavage site at the carboxy-terminus of its Shiga toxin A1 fragment region (SLT-1A-FR (SEQ ID NO:5)). The percent viability of target positive cells for each cell type was plotted over the logarithm to base 10 of the cell-targeting molecule concentration administered to the respective cells.

FIG. 3 graphically shows that the exemplary cell-targeting molecule SLT-1A-combo7::scFv-1 (SEQ ID NO:44) exhibited cytotoxicity to two, different cell-types comparable to a "control" cell-targeting molecule SLT-1A-FR::scFv-1 (SEQ ID NO:34).

FIG. 4 graphically shows that the exemplary cell-targeting molecule SLT-1A-combo7::scFv-1 (SEQ ID NO:44) exhibited cytotoxicity to a target-positive cell type comparable to a "control" cell-targeting molecule SLT-1A-FR::scFv-1 (SEQ ID NO:34). The specificity of cell-targeting was shown by using the same assay with a cell line negative for cell-surface expression of a target biomolecule of scFv-1. In FIG. 4 for cell-line H, the percent viability of target negative cells was plotted over the logarithm to base 10 of the cell-targeting molecule concentration administered to the cells. FIG. 4 shows that the cell-targeting molecule SLT-1A-combo7::scFv-1 (SEQ ID NO:44) did not exhibit cytotoxicity to a target negative cell type at the concentrations tested.

FIG. 5 graphically shows that the exemplary cell-targeting molecules SLT-1A-combo10::scFv-1 (SEQ ID NO:47), SLT-1A-combo16::scFv-1 (SEQ ID NO:52), and SLT-1A-combo19::scFv-1 (SEQ ID NO:55) exhibited cytotoxicity to two, different cell-types comparable to a "control" cell-targeting molecule SLT-1A-FR::scFv-1 (SEQ ID NO:34).

FIG. 6 graphically shows that the exemplary cell-targeting molecule SLT-1A-combo17::scFv-1 (SEQ ID NO:53) exhibited cytotoxicity to cell-line A comparable to a "control" cell-targeting molecule SLT-1A-FR::scFv-1 (SEQ ID NO:34); whereas SLT-1A-combo17::scFv-1 (SEQ ID NO:53) exhibited attenuated cytotoxicity to cell-line B as compared to the control. FIG. 6 shows that the cell-targeting molecule SLT-1A-combo18::scFv-1 (SEQ ID NO:54) did not exhibit cytotoxicity to both cell-types tested at concentrations up to 100 nM. The cytotoxicity results from this assay for an untargeted, wild-type Shiga toxin A1 fragment in lieu of a cell-targeting molecule are shown as well.

FIG. 7 graphically shows that the exemplary cell-targeting molecule SLT-1A-combo2::scFv-2 (SEQ ID NO:58) exhibited cytotoxicity to cell-lines B and G comparable to a "control" cell-targeting molecule SLT-1A-FR::scFv-2 (SEQ ID NO:35); whereas SLT-1A-combo2::scFv-2 (SEQ ID NO:58) exhibited slightly attenuated cytotoxicity to cell-line A as compared to the control. FIG. 7 shows that the cell-targeting molecule SLT-1A-combo13::scFv-2 (SEQ ID NO:62) exhibited strongly attenuated cytotoxicity to the three cell-types tested as compared to the control.

FIG. 8 graphically shows that exemplary cell-targeting molecules of the present invention scFv-3::SLT-1A-combo5 (SEQ ID NO:64) and scFv-3::SLT-1A-combo6 (SEQ ID NO:65) exhibited cell-targeted cytotoxicity to two, different, target positive cell types comparable to a "control" cell-targeting molecule scFv-3::SLT-1A-WT (SEQ ID NO:33), whose Shiga toxin A Subunit component was a wild-type Shiga toxin A Subunit fragment. The percent viability of target positive cells for two, different, cell types was plotted over the logarithm to base 10 of the cell-targeting molecule concentration administered to the cells. For cell-line B, both scFv-3::SLT-1A-combo5 (SEQ ID NO:64) and scFv-3::SLT-1A-combo6 (SEQ ID NO:65) exhibited cytotoxic potency as measured by $CD_{50}$ values lesser than an equivalent level of the control. The specificity of cell-targeting was shown by using the same assay with a cell line negative for cell-surface expression of a target biomolecule of scFv-3. In FIG. 8 for cell-line A, the percent viability of target negative cells was plotted over the logarithm to base 10 of the cell-targeting molecule concentration administered to the cells. FIG. 8 shows that the cell-targeting molecules scFv-3::SLT-1A-combo5 (SEQ ID NO:64) and scFv-3::SLT-1A-combo6 (SEQ ID NO:65) exhibited untargeted cytotoxicity to a target negative cell type comparable to the control.

FIG. 9 graphically shows that the exemplary cell-targeting molecules SLT-1A-combo7::scFv-4 (SEQ ID NO:66) and SLT-1A-combo14::scFv-4 (SEQ ID NO:67) exhibited cell-targeted cytotoxicity to a target positive cell type comparable to a "control" cell-targeting molecule SLT-1A-FR::scFv-4 (SEQ ID NO:36). The specificity of cell-targeting was shown by using the same assay with a cell line negative for cell-surface expression of a target biomolecule of scFv-4. In FIG. 9 for cell-line E, the percent viability of target negative cells was plotted over the logarithm to base 10 of the cell-targeting molecule concentration administered to the cells. FIG. 9 shows that the cell-targeting molecules SLT-1A-combo7::scFv-4 (SEQ ID NO:66) and SLT-1A-combo14::scFv-4 (SEQ ID NO:67) exhibited untargeted cytotoxicity to a target negative cell type comparable to the control.

FIG. 10 graphically shows that the exemplary cell-targeting molecule SLT-1A-combo8::scFv-5 (SEQ ID NO:69) exhibited cell-targeted cytotoxicity to a target positive cell type comparable to a "control" cell-targeting molecule SLT-1A-FR::scFv-5 (SEQ ID NO:37). The cell-targeting molecule SLT-1A-combo9::scFv-5 (SEQ ID NO:70) exhibited attenuated cytotoxicity to this cell line as compared to the control, and SLT-1A-combo11::scFv-5 (SEQ ID NO:71) exhibited very low cytotoxic potency compared to the control.

FIGS. 11-12 graphically show the caspase activity induced by exemplary cell-targeting molecules of the present invention SLT-1A-combo(n)::scFv-1 as compared to the "control" cell-targeting molecule SLT-1A-FR::scFv-(n), whose Shiga toxin effector polypeptide component consisted of a wild-type Shiga toxin A Subunit fragment except for it comprised a disrupted, furin-cleavage site at the carboxy-terminus of its Shiga toxin A1 fragment region (SLT-1A-FR (SEQ ID NO:5)). The percent caspase activity was plotted over the logarithm to base 10 of the cell-targeting molecule concentration administered to the cells. FIGS. 11-12 show that the exemplary, cell-targeting molecules SLT-1A-combo7::scFv-1 (SEQ ID NO:44), SLT-1A-combo14::scFv-1 (SEQ ID NO:50), and SLT-1A-combo7::scFv-7 (SEQ ID NO:81) induced caspase activity comparable to a control cell-targeting molecule for at least one cell line tested.

FIG. 13 shows the relative antigenicities of exemplary cell-targeting molecules of the present invention and a control cell-targeting molecule by Western blot analysis under denaturing conditions using three, different antibodies recognizing Shiga toxin A1 fragments. FIG. 13 show pictures of multiple replicate gels and membranes. The first lane marked “MW Marker” shows the migration pattern of a protein molecular weight ladder, and the approximate size of each ladder protein band is labeled in kiloDaltons (kDa). The samples loaded and run in lanes numbered 1-4 are indicated in the figure legend: #1) SLT-1A::combo7::scFv-1 (SEQ ID NO:44); #2) SLT-1A-FR::scFv-1 (SEQ ID NO:34); #3 SLT-1A::combo14::scFv-1 (SEQ ID NO:50); and SLT-1A::combo10::scFv-1 (SEQ ID NO:47). The top panel shows pictures of a coomassie-stained replicate gel; the second panel (from the top) shows pictures of replicate membrane probed with α-SLT-1A pAb1, third panel (from the top) shows pictures of a replicate membrane probed with α-SLT-1A pAb2, and the last panel (from the top) shows pictures of a replicate membrane probed with α-StxA mAb. FIG. 13 shows that the exemplary cell-targeting molecules SLT-1A-combo7::scFv-1 (SEQ ID NO:44), SLT-1A-combo10::scFv-1 (SEQ ID NO:47), and SLT-1A-combo14::scFv-1 (SEQ ID NO:50) each have reduced antigenicity in this assay compared to the reference molecule SLT-1A-FR::scFv-1 (SEQ ID NO:34).

FIG. 14 graphically shows the relative antigenicities of exemplary cell-targeting molecules of the present invention and a control cell-targeting molecule by ELISA analysis using two, different antibodies recognizing Shiga toxin A1 fragments. The normalized ELISA absorbance signal is graphed as a percentage of the control molecule SLT-1A-FR::scFv-1 (SEQ ID NO:34). FIG. 14 shows that the exemplary cell-targeting molecules SLT-1A-combo7::scFv-1 (SEQ ID NO:44), SLT-1A-combo10::scFv-1 (SEQ ID NO:47), and SLT-1A-combo14::scFv-1 (SEQ ID NO:50) each have reduced antigenicity in this assay compared to the control.

FIGS. 15-16 graphically show the relative immunogenicities of exemplary cell-targeting molecules of the present invention measured from sera collected from a mammalian model and using in-solution ELISA assays to detect in the serum of each animal the quantity of antibodies which recognize an administered Shiga toxin A Subunit derived molecule. The reference cell-targeting molecules used for relative comparisons were SLT-1A-FR::scFv-(n), whose Shiga toxin effector polypeptide component consisted of the furin-cleavage resistant, Shiga toxin effector polypeptide SLT-1A-FR (SEQ ID NO:5). For each animal treatment group administered a cell-targeting molecule of the present invention, the percentage values of the SLT-1A-FR::scFv-(n) reference molecule treatment group was calculated by dividing the average ELISA signal for all the subjects in the cell-targeting molecule treatment group at a given time-point with the average ELISA signal of the subjects in the SLT-1A-FR::scFv-(n) reference treatment group. The percentage of the reference for each experimental treatment group was graphed on the Y-axis, and the day of serum collection was graphed on the X-axis. The symbols in FIGS. 15-16 represent the average signal for individual subjects in the indicated group, and the error bars indicate the standard error of the mean for the subjects in the group at the indicated time-point. FIGS. 15-16 show that the exemplary cell-targeting molecules SLT-1A-combo1::scFv-1 (SEQ ID NO:43), SLT-1A-combo7::scFv-1 (SEQ ID NO:44), SLT-1A-combo10::scFv-1 (SEQ ID NO:47), SLT-1A-combo12::scFv-1 (SEQ ID NO:49), SLT-1A-combo15::scFv-1 (SEQ ID NO:51), SLT-1A-combo16::scFv-1 (SEQ ID NO:52), SLT-1A-combo19::scFv-1 (SEQ ID NO:55), SLT-1A-combo10::scFv-2 (SEQ ID NO:61), and SLT-1A-combo22::scFv-2 (SEQ ID NO:63) exhibited reduced immunogenicity in this assay relative to the appropriate, reference molecule SLT-1A-FR::scFv-(n) (SEQ ID NO:34 or 35).

FIG. 17 shows the furin-cleavage resistance of the cell-targeted molecule SLT-1A-FR::scFv-9, which comprised a Shiga toxin effector polypeptide comprising a disrupted furin-cleavage motif, as compared to a nearly identical, cytotoxic, cell-targeted molecule comprising a wild-type Shiga toxin A1 fragment with a wild-type furin-cleavage site (SLT-1A-WT::scFv-9). FIG. 17 shows a coomassie-stained, polyacrylamide gel after electrophoresis of protein samples treated with either purified, recombinant, human furin or various negative control conditions. The lanes of the gel are numbered, and the figure legend indicates pre-treatment conditions of each cell-targeted molecule sample prior to loading sample to the gel: the temperature in degrees Celsius (° C.), the pre-treatment duration in hours, and whether any furin was added by denoting the amount of furin activity units added (U) per microgram (μg) of cell-targeted molecule (labeled “U/μg furin”) or “no furin” for zero U/μg furin added. The first lane marked “MW Marker” shows the migration pattern of a protein molecular weight ladder, and the approximate size of each ladder protein band is labeled in kiloDaltons (kDa). The figure legend indicates which Shiga toxin effector region was present in each cell-targeted molecule sample per lane, either 1) a wild-type furin site (WT) or 2) a disrupted furin motif (FR). The treated samples were subjected to 0.5 furin activity units per microgram of cell-targeted molecule (U/μg furin) at 30° C. for 30 hours. FIG. 17 shows SLT-1A-FR::scFv-9 was resistant to 0.5 furin activity units per microgram of SLT-1A-FR::scFv-9 at 30° C.

FIG. 18 graphically shows the specific binding of an exemplary, cell-targeting molecule of the present invention (SEQ ID NO:82) to target positive cells as compared to target negative cells. The amount of cell-targeting molecule binding to cells was calculated as an integrated, mean fluorescence intensity (iMFI) and graphed versus the concentration of the cell-targeting molecule. Curve fitting of the data was used to produce the lines for the two, target-positive cell-types tested.

FIG. 19 graphically shows the change in human tumor burdens over time for groups of subjects in a murine xenograft model after receiving either an exemplary, cell-targeting molecule of the present invention or a vehicle-only control sample. The tumor burden measured as whole body bioluminescence in photons/second was graphed versus time (days post-tumor implant). Administration of the cell-targeting molecule SLT1-A-combo7::αCD38-scFv-1 (SEQ ID NO:82) prevented the increase in tumor burden observed for the vehicle only control group.

DETAILED DESCRIPTION

Figure 1:
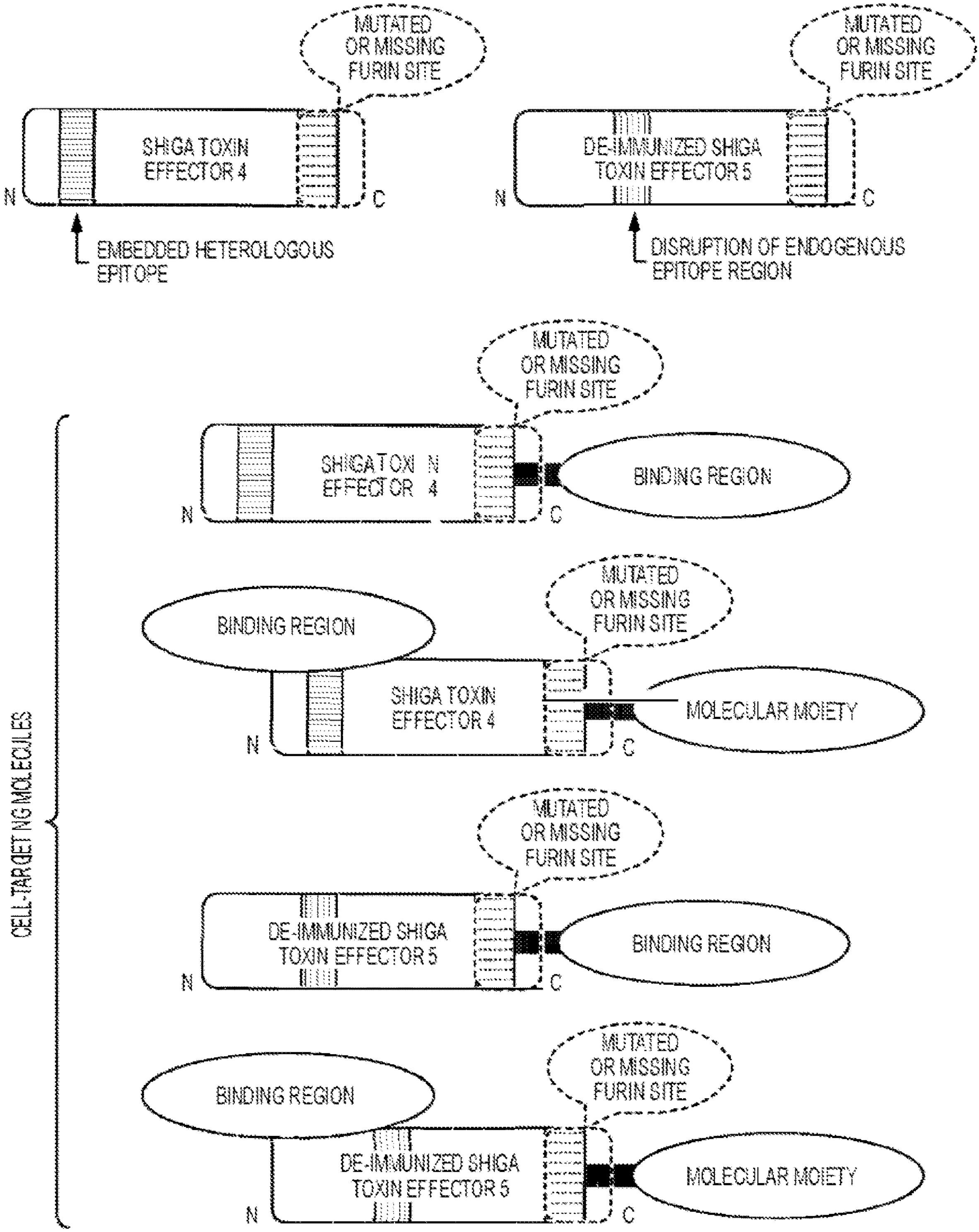
FIG. 1 depicts exemplary, Shiga toxin A Subunit effector polypeptides of the present invention (numbered 1-5) and cell-targeting molecules comprising the same (e.g. "2/3" denotes either Shiga toxin effector polypeptide 2 or 3). The depictions of exemplary molecules in FIG. 1 are for illustrative purposes of certain, general arrangements of the structural features of a limited set of embodiments of the present invention. It is to be understood that these exemplary molecules do not intend, nor should any be construed, to be wholly definitive as to the arrangement of any structural features and/or components of a molecule of the present invention. The relative size, location, or number of features shown in the schematics of FIG. 1 have been simplified. For example, the relative positions of embedded, heterologous epitopes and disruptions of an endogenous, epitope regions are not fixed. Similarly, the total numbers of embedded, heterologous epitopes and disruptions of an endogenous, epitope regions are not fixed. Certain embodiments of the molecules of the present invention comprise a plurality of disrupted, endogenous, epitope regions in a single, Shiga toxin effector polypeptide, such as, e.g., disruptions of four, five, six, seven, eight, nine, or more regions; wherein these disrupted, endogenous, epitope regions may be distributed throughout the Shiga toxin effector polypeptide, including disruptions which overlap with or are within the furin-cleavage motif of the carboxy-terminus region of a Shiga toxin A1 fragment derived region (see Table 8, infra). Certain embodiments of the present invention comprise disruptions of endogenous, epitope regions which are carboxy-terminal to the carboxy-terminus of the Shiga toxin A1 fragment, or a derivative thereof, such as, e.g. at a position carboxy-terminal to any disrupted furin-cleavage site motif. The schematics in FIG. 1 are not intended to accurately portray any information regarding the relative sizes of molecular structures in any embodiment of the present invention.

The present invention is described more fully hereinafter using illustrative, non-limiting embodiments, and references to the accompanying figures. This invention may, however, be embodied in many different forms and should not be construed as to be limited to the embodiments set forth below. Rather, these embodiments are provided so that this disclosure is thorough and conveys the scope of the invention to those skilled in the art.

In order that the present invention may be more readily understood, certain terms are defined below. Additional definitions may be found within the detailed description of the invention.

As used in the specification and the appended claims, the terms "a," "an" and "the" include both singular and the plural referents unless the context clearly dictates otherwise.

As used in the specification and the appended claims, the term "and/or" when referring to two species, A and B, means at least one of A and B. As used in the specification and the appended claims, the term "and/or" when referring to greater than two species, such as A, B, and C, means at least one of A, B, or C, or at least one of any combination of A, B, or C (with each species in singular or multiple possibility).

Throughout this specification, the word "comprise" or variations such as "comprises" or "comprising" will be understood to imply the inclusion of a stated integer (or components) or group of integers (or components), but not the exclusion of any other integer (or components) or group of integers (or components).

Throughout this specification, the term "including" is used to mean "including but not limited to." "Including" and "including but not limited to" are used interchangeably.

The term "amino acid residue" or "amino acid" includes reference to an amino acid that is incorporated into a protein, polypeptide, or peptide. The term "polypeptide" includes any polymer of amino acids or amino acid residues. The term "polypeptide sequence" refers to a series of amino acids or amino acid residues which physically comprise a polypeptide. A "protein" is a macromolecule comprising one or more polypeptides or polypeptide "chains." A "peptide" is a small polypeptide of sizes less than about a total of 15 to 20 amino acid residues. The term "amino acid sequence" refers to a series of amino acids or amino acid residues which physically comprise a peptide or polypeptide depending on the length. Unless otherwise indicated, polypeptide and protein sequences disclosed herein are written from left to right representing their order from an amino-terminus to a carboxy-terminus.

The terms "amino acid," "amino acid residue," "amino acid sequence," or polypeptide sequence include naturally occurring amino acids (including L and D isosteriomers) and, unless otherwise limited, also include known analogs of natural amino acids that can function in a similar manner as naturally occurring amino acids, such as selenocysteine, pyrrolysine, N-formylmethionine, gamma-carboxyglutamate, hydroxyprolinehypusine, pyroglutamic acid, and selenomethionine. The amino acids referred to herein are described by shorthand designations as follows in Table A:

TABLE A

Amino Acid Nomenclature

| Name | 3-letter | 1-letter |
|---|---|---|
| Alanine | Ala | A |
| Arginine | Arg | R |
| Asparagine | Asn | N |
| Aspartic Acid or Aspartate | Asp | D |
| Cysteine | Cys | C |
| Glutamic Acid or Glutamate | Glu | E |
| Glutamine | Gln | Q |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

The phrase "conservative substitution" with regard to an amino acid residue of a peptide, peptide region, polypeptide region, protein, or molecule refers to a change in the amino acid composition of the peptide, peptide region, polypeptide region, protein, or molecule that does not substantially alter the function and structure of the overall peptide, peptide region, polypeptide region, protein, or molecule (see Creighton, *Proteins: Structures and Molecular Properties* (W. H. Freeman and Company, New York (2nd ed., 1992))).

For purposes of the present invention, the phrase "derived from" when referring to a polypeptide or polypeptide region means that the polypeptide or polypeptide region comprises amino acid sequences originally found in a "parental" protein and which may now comprise certain amino acid residue additions, deletions, truncations, rearrangements, or other alterations relative to the original polypeptide or polypeptide region as long as a certain function(s) and a structure(s) of the "parental" molecule are substantially conserved. The skilled worker will be able to identify a parental molecule from which a polypeptide or polypeptide region was derived using techniques known in the art, e.g., protein sequence alignment software.

For purposes of the claimed invention and with regard to a Shiga toxin polypeptide sequence or Shiga toxin derived polypeptide, the term "wild-type" generally refers to a naturally occurring, Shiga toxin protein sequence(s) found in a living species, such as, e.g., a pathogenic bacterium, wherein that Shiga toxin protein sequence(s) is one of the most frequently occurring variants. This is in contrast to infrequently occurring Shiga toxin protein sequences that, while still naturally occurring, are found in less than one percent of individual organisms of a given species when sampling a statistically powerful number of naturally occurring individual organisms of that species which comprise at least one Shiga toxin protein variant. A clonal expansion of a natural isolate outside its natural environment (regardless of whether the isolate is an organism or molecule comprising biological sequence information) does not alter the naturally occurring requirement as long as the clonal expansion does not introduce new sequence variety not present in naturally occurring populations of that species and/or does not change the relative proportions of sequence variants to each other.

The terms "associated," "associating," "linked," or "linking" with regard to the claimed invention refers to the state of two or more components of a molecule being joined, attached, connected, or otherwise coupled to form a single molecule or the act of making two molecules associated with each other to form a single molecule by creating an association, linkage, attachment, and/or any other connection between the two molecules. For example, the term "linked" may refer to two or more components associated by one or more atomic interactions such that a single molecule is formed and wherein the atomic interactions may be covalent and/or non-covalent. Non-limiting examples of covalent associations between two components include peptide bonds and cysteine-cysteine disulfide bonds. Non-limiting examples of non-covalent associations between two molecular components include ionic bonds.

For purposes of the present invention, the term "linked" refer to two or more molecular components associated by one or more atomic interactions such that a single molecule is formed and wherein the atomic interactions includes at least one covalent bond. For purposes of the present invention, the term "linking" refers to the act of creating a linked molecule as described above.

For purposes of the present invention, the term "fused" refers to two or more proteinaceous components associated by at least one covalent bond which is a peptide bond, regardless of whether the peptide bond involves the participation of a carbon atom of a carboxyl acid group or involves another carbon atom, such as, e.g., the α-carbon, β-carbon, γ-carbon, σ-carbon, etc. Non-limiting examples of two proteinaceous components fused together include, e.g., an amino acid, peptide, or polypeptide fused to a polypeptide via a peptide bond such that the resulting molecule is a single, continuous polypeptide. For purposes of the present invention, the term "fusing" refers to the act of creating a fused molecule as described above, such as, e.g., a fusion protein generated from the recombinant fusion of genetic regions which when translated produces a single proteinaceous molecule.

The symbol "::" means the polypeptide regions before and after it are physically linked together to form a continuous polypeptide.

As used herein, the terms "expressed," "expressing," or "expresses," and grammatical variants thereof, refer to translation of a polynucleotide or nucleic acid into a protein. The expressed protein may remain intracellular, become a component of the cell surface membrane or be secreted into an extracellular space.

As used herein, cells which express a significant amount of an extracellular target biomolecule at least one cellular surface are "target positive cells" or "target+ cells" and are cells physically coupled to the specified, extracellular target biomolecule.

As used herein, the symbol "α" is shorthand for an immunoglobulin-type binding region capable of binding to the biomolecule following the symbol. The symbol "α" is used to refer to the functional characteristic of an immunoglobulin-type binding region based on its ability to bind to the biomolecule following the symbol with a binding affinity described by a dissociation constant ($K_D$) of $10^{-5}$ or less.

As used herein, the term "heavy chain variable ($V_H$) domain" or "light chain variable ($V_L$) domain" respectively refer to any antibody $V_H$ or $V_L$ domain (e.g. a human $V_H$ or $V_L$ domain) as well as any derivative thereof retaining at least qualitative antigen binding ability of the corresponding native antibody (e.g. a humanized $V_H$ or $V_L$ domain derived from a native murine $V_H$ or $V_L$ domain). A $V_H$ or $V_L$ domain consists of a "framework" region interrupted by the three CDRs or ABRs. The framework regions serve to align the CDRs or ABRs for specific binding to an epitope of an antigen. From amino-terminus to carboxy-terminus, both $V_H$ and $V_L$ domains comprise the following framework (FR) and CDR regions or ABR regions: FR1, CDR1, FR2, CDR2, FR3, CDR3, and FR4; or, similarly, FR1, ABR1, FR2, ABR2, FR3, ABR3, and FR4. As used herein, the terms "HCDR1," "HCDR2," or "HCDR3" are used to refer to CDRs 1, 2, or 3, respectively, in a $V_H$ domain, and the terms "LCDR1," "LCDR2," and "LCDR3" are used to refer to CDRs 1, 2, or 3, respectively, in a $V_L$ domain. As used herein, the terms "HABR1," "HABR2," or "HABR3" are used to refer to ABRs 1, 2, or 3, respectively, in a $V_H$ domain, and the terms "LABR1," "LABR2," or "LABR3" are used to refer to CDRs 1, 2, or 3, respectively, in a $V_L$ domain. For camelid $V_H$H fragments, IgNARs of cartilaginous fish, $V_{NAR}$ fragments, certain single domain antibodies, and derivatives thereof, there is a single, heavy chain variable domain comprising the same basic arrangement: FR1, CDR1, FR2, CDR2, FR3, CDR3, and FR4. As used herein, the terms "HCDR1," "HCDR2," or "HCDR3" may be used to refer to CDRs 1, 2, or 3, respectively, in a single heavy chain variable domain.

For purposes of the present invention, the term "effector" means providing a biological activity, such as cytotoxicity, biological signaling, enzymatic catalysis, subcellular routing, and/or intermolecular binding resulting in an allosteric effect(s) and/or the recruitment of one or more factors.

For purposes of the present invention, the phrases "Shiga toxin effector polypeptide," "Shiga toxin effector polypeptide region," and "Shiga toxin effector region" refer to a polypeptide or polypeptide region derived from at least one Shiga toxin A Subunit of a member of the Shiga toxin family wherein the polypeptide or polypeptide region is capable of exhibiting at least one Shiga toxin function. For example, SEQ ID NOs: 8, 11-27, 29-32, 348, 356-358, 363, 370-371, 373, 378-438 are derived from StxA and SLT-1A.

For purposes of the present invention, a Shiga toxin effector function is a biological activity conferred by a polypeptide region derived from a Shiga toxin A Subunit. Non-limiting examples of Shiga toxin effector functions include promoting cell entry; lipid membrane deformation; promoting cellular internalization; stimulating clathrin-mediated endocytosis; directing intracellular routing to various intracellular compartments such as, e.g., the Golgi, endoplasmic reticulum, and cytosol; directing intracellular routing with a cargo; inhibiting a ribosome function(s); catalytic activities, such as, e.g., N-glycosidase activity and catalytically inhibiting ribosomes; reducing protein synthesis, inducing caspase activity, activating effector caspases, effectuating cytostatic effects, and cytotoxicity. Shiga toxin catalytic activities include, for example, ribosome inactivation, protein synthesis inhibition, N-glycosidase activity, polynucleotide:adenosine glycosidase activity, RNAase activity, and DNAase activity. Shiga toxins are ribosome inactivating proteins (RIPs). RIPs can depurinate nucleic acids, polynucleosides, polynucleotides, rRNA, ssDNA, dsDNA, mRNA (and polyA), and viral nucleic acids (see e.g., Barbieri L et al., *Biochem J* 286: 1-4 (1992); Barbieri L et al., *Nature* 372: 624 (1994); Ling J et al., *FEBS Lett* 345: 143-6 (1994); Barbieri L et al., *Biochem J* 319: 507-13 (1996); Roncuzzi L, Gasperi-Campani A, *FEBS Lett* 392: 16-20 (1996); Stirpe F et al., *FEBS Lett* 382: 309-12 (1996); Barbieri L et al., *Nucleic Acids Res* 25: 518-22 (1997); Wang P, Tumer N, *Nucleic Acids Res* 27: 1900-5 (1999); Barbieri L et al., *Biochim Biophys Acta* 1480: 258-66 (2000); Barbieri L et al., *J Biochem* 128: 883-9 (2000); Brigotti M et al., *Toxicon* 39: 341-8 (2001); Brigotti M et al., *FASEB J* 16: 365-72 (2002); Bagga S et al., *J Biol Chem* 278: 4813-20 (2003); Picard D et al., *J Biol Chem* 280: 20069-75 (2005)). Some RIPs show antiviral activity and superoxide dismutase activity (Erice A et al., *Antimicrob Agents Chemother* 37: 835-8 (1993); Au T et al., *FEBS Lett* 471: 169-72 (2000);

Parikh B, Tumer N, *Mini Rev Med Chem* 4:523-43 (2004); Sharma N et al., *Plant Physiol* 134: 171-81 (2004)). Shiga toxin catalytic activities have been observed both in vitro and in vivo. Non-limiting examples of assays for Shiga toxin effector activity measure various activities, such as, e.g., protein synthesis inhibitory activity, depurination activity, inhibition of cell growth, cytotoxicity, supercoiled DNA relaxation activity, and nuclease activity.

As used herein, the retention of Shiga toxin effector function refers to being capable of exhibiting a level of Shiga toxin functional activity, as measured by an appropriate quantitative assay with reproducibility, comparable to a wild-type, Shiga toxin effector polypeptide control (e.g. a Shiga toxin A1 fragment) or cell-targeting molecule comprising a wild-type Shiga toxin effector polypeptide (e.g. a Shiga toxin A1 fragment) under the same conditions. For the Shiga toxin effector function of ribosome inactivation or ribosome inhibition, retained Shiga toxin effector function is exhibiting an $IC_{50}$ of 10,000 pM or less in an in vitro setting, such as, e.g., by using an assay known to the skilled worker and/or described herein. For the Shiga toxin effector function of cytotoxicity in a target positive cell-kill assay, retained Shiga toxin effector function is exhibiting a $CD_{50}$ of 1,000 nM or less, depending on the cell type and its expression of the appropriate extracellular target biomolecule, as shown, e.g., by using an assay known to the skilled worker and/or described herein.

For purposes of the claimed invention, the term "equivalent" with regard to ribosome inhibition means an empirically measured level of ribosome inhibitory activity, as measured by an appropriate quantitative assay with reproducibility, which is reproducibly within 10% or less of the activity of the reference molecule (e.g., the second cell-targeting molecule or third cell-targeting molecule) under the same conditions.

For purposes of the claimed invention, the term "equivalent" with regard to cytotoxicity means an empirically measured level of cytotoxicity, as measured by an appropriate quantitative assay with reproducibility, which is reproducibly within 10% or less of the activity of the reference molecule (e.g., the second cell-targeting molecule or third cell-targeting molecule) under the same conditions.

As used herein, the term "attenuated" with regard to cytotoxicity means a molecule exhibits or exhibited a $CD_{50}$ between 10-fold to 100-fold of a $CD_{50}$ exhibited by a reference molecule under the same conditions.

Inaccurate $IC_{50}$ and $CD_{50}$ values should not be considered when determining a level of Shiga toxin effector function activity. For some samples, accurate values for either $IC_{50}$ or $CD_{50}$ might be unobtainable due to the inability to collect the required data points for an accurate curve fit. For example, theoretically, neither an $IC_{50}$ nor $CD_{50}$ can be determined if greater than 50% ribosome inhibition or cell death, respectively, does not occur in a concentration series for a given sample. Data insufficient to accurately fit a curve as described in the analysis of the data from exemplary Shiga toxin effector function assays, such as, e.g., assays described in the Examples below, should not be considered as representative of actual Shiga toxin effector function.

A failure to detect activity in Shiga toxin effector function may be due to improper expression, polypeptide folding, and/or protein stability rather than a lack of cell entry, subcellular routing, and/or enzymatic activity. Assays for Shiga toxin effector functions may not require much polypeptide of the invention to measure significant amounts of Shiga toxin effector function activity. To the extent that an underlying cause of low or no effector function is determined empirically to relate to protein expression or stability, one of skill in the art may be able to compensate for such factors using protein chemistry and molecular engineering techniques known in the art, such that a Shiga toxin functional effector activity may be restored and measured. As examples, improper cell-based expression may be compensated for by using different expression control sequences; and improper polypeptide folding and/or stability may benefit from stabilizing terminal sequences, or compensatory mutations in non-effector regions which stabilize the three dimensional structure of the molecule.

Certain Shiga toxin effector functions are not easily measurable, e.g. subcellular routing functions. For example, there is no routine, quantitative assay to distinguish whether the failure of a Shiga toxin effector polypeptide to be cytotoxic and/or deliver a heterologous epitope is due to improper subcellular routing, but at a time when tests are available, then Shiga toxin effector polypeptides may be analyzed for any significant level of subcellular routing as compared to the appropriate wild-type Shiga toxin effector polypeptide. However, if a Shiga toxin effector polypeptide component of a cell-targeting molecule of the present invention exhibits cytotoxicity comparable or equivalent to a wild-type Shiga toxin A Subunit construct, then the subcellular routing activity level is inferred to be comparable or equivalent, respectively, to the subcellular routing activity level of a wild-type Shiga toxin A Subunit construct at least under the conditions tested.

When new assays for individual Shiga toxin functions become available, Shiga toxin effector polypeptides and/or cell-targeting molecules comprising Shiga toxin effector polypeptides may be analyzed for any level of those Shiga toxin effector functions, such as a being within 1000-fold or 100-fold or less the activity of a wild-type Shiga toxin effector polypeptide or exhibiting 3-fold to 30-fold or greater activity as compared to a functional knockout, Shiga toxin effector polypeptide.

Sufficient subcellular routing may be merely deduced by observing a molecule's cytotoxic activity levels in cytotoxicity assays, such as, e.g., cytotoxicity assays based on T-cell epitope presentation or based on a toxin effector function involving a cytosolic and/or endoplasmic reticulum-localized, target substrate.

As used herein, the retention of "significant" Shiga toxin effector function refers to a level of Shiga toxin functional activity, as measured by an appropriate quantitative assay with reproducibility comparable to a wild-type Shiga toxin effector polypeptide control (e.g. a Shiga toxin A1 fragment). For in vitro ribosome inhibition, significant Shiga toxin effector function is exhibiting an $IC_{50}$ of 300 pM or less depending on the source of the ribosomes used in the assay (e.g. a bacterial, archaeal, or eukaryotic (algal, fungal, plant, or animal) source). This is significantly greater inhibition as compared to the approximate $IC_{50}$ of 100,000 pM for the catalytically disrupted SLT-1A 1-251 double mutant (Y77S/E167D). For cytotoxicity in a target-positive cell-kill assay in laboratory cell culture, significant Shiga toxin effector function is exhibiting a $CD_{50}$ of 100, 50, 30 nM, or less, depending on the target biomolecule(s) of the binding region and the cell type, particularly that cell type's expression and/or cell-surface representation of the appropriate extracellular target biomolecule(s) and/or the extracellular epitope(s) targeted by the molecule being evaluated. This is significantly greater cytotoxicity to the appropriate, target-positive cell population as compared to a Shiga toxin A Subunit alone (or a wild-type Shiga toxin A1 fragment), without a cell targeting binding region, which has a $CD_{50}$ of 100-10,000 nM, depending on the cell line.

For purposes of the present invention and with regard to the Shiga toxin effector function of a molecule of the present invention, the term "reasonable activity" refers to exhibiting at least a moderate level (e.g. within 11-fold to 1,000-fold) of Shiga toxin effector activity as defined herein in relation to a molecule comprising a naturally occurring Shiga toxin, wherein the Shiga toxin effector activity is selected from the group consisting of internalization efficiency, subcellular routing efficiency to the cytosol, delivered epitope presentation by a target cell(s), ribosome inhibition, and cytotoxicity. For cytotoxicity, a reasonable level of Shiga toxin effector activity includes being within 1,000-fold of a wild-type, Shiga toxin construct, such as, e.g., exhibiting a $CD_{50}$ of 500 nM or less when a wild-type Shiga toxin construct exhibits a $CD_{50}$ of 0.5 nM (e.g. a cell-targeting molecule comprising a wild-type Shiga toxin A1 fragment).

For purposes of the present invention and with regard to the cytotoxicity of a molecule of the present invention, the term "optimal" refers to a level of Shiga toxin catalytic domain mediated cytotoxicity that is within 2, 3, 4, 5, 6, 7, 8, 9, or 10-fold of the cytotoxicity of a molecule comprising wild-type Shiga toxin A1 fragment (e.g. a Shiga toxin A Subunit or certain truncated variants thereof) and/or a naturally occurring Shiga toxin.

It should be noted that even if the cytotoxicity of a Shiga toxin effector polypeptide is reduced relative to a wild-type Shiga toxin A Subunit or fragment thereof, in practice, applications using attenuated, Shiga toxin effector polypeptides may be equally or more effective than using wild-type Shiga toxin effector polypeptides because the highest potency variants might exhibit undesirable effects which are minimized or reduced in reduced cytotoxic-potency variants. Wild-type Shiga toxins are very potent, being able to kill an intoxicated cell after only one toxin molecule has reached the cytosol of the intoxicated cell or perhaps after only forty toxin molecules have been internalized into the intoxicated cell. Shiga toxin effector polypeptides with even considerably reduced Shiga toxin effector functions, such as, e.g., subcellular routing or cytotoxicity, as compared to wild-type Shiga toxin effector polypeptides may still be potent enough for practical applications, such as, e.g., applications involving targeted cell-killing, heterologous epitope delivery, and/or detection of specific cells and their subcellular compartments. In addition, certain reduced-activity Shiga toxin effector polypeptides may be particularly useful for delivering cargos (e.g. an additional exogenous material or T-cell epitope) to certain intracellular locations or subcellular compartments of target cells.

The term "selective cytotoxicity" with regard to the cytotoxic activity of a molecule refers to the relative level of cytotoxicity between a biomolecule target positive cell population (e.g. a targeted cell-type) and a non-targeted bystander cell population (e.g. a biomolecule target negative cell-type), which can be expressed as a ratio of the half-maximal cytotoxic concentration ($CD_{50}$) for a targeted cell type over the $CD_{50}$ for an untargeted cell type to provide a metric of cytotoxic selectivity or indication of the preferentiality of killing of a targeted cell versus an untargeted cell.

The cell surface representation and/or density of a given extracellular target biomolecule (or extracellular epitope of a given target biomolecule) may influence the applications for which certain cell-targeting molecules of the present invention may be most suitably used. Differences in cell surface representation and/or density of a given target biomolecule between cells may alter, both quantitatively and qualitatively, the efficiency of cellular internalization and/or cytotoxicity potency of a given cell-targeting molecule of the present invention. The cell surface representation and/or density of a given target biomolecule can vary greatly among target biomolecule positive cells or even on the same cell at different points in the cell cycle or cell differentiation. The total cell surface representation of a given target biomolecule and/or of certain extracellular epitopes of a given target biomolecule on a particular cell or population of cells may be determined using methods known to the skilled worker, such as methods involving fluorescence-activated cell sorting (FACS) flow cytometry.

As used herein, the terms "disrupted," "disruption," or "disrupting," and grammatical variants thereof, with regard to a polypeptide region or feature within a polypeptide refers to an alteration of at least one amino acid within the region or composing the disrupted feature. Amino acid alterations include various mutations, such as, e.g., a deletion, inversion, insertion, or substitution which alter the amino acid sequence of the polypeptide. Amino acid alterations also include chemical changes, such as, e.g., the alteration one or more atoms in an amino acid functional group or the addition of one or more atoms to an amino acid functional group.

As used herein, "de-immunized" means reduced antigenic and/or immunogenic potential after administration to a chordate as compared to a reference molecule, such as, e.g., a wild-type peptide region, polypeptide region, or polypeptide. This includes a reduction in overall antigenic and/or immunogenic potential despite the introduction of one or more, de novo, antigenic and/or immunogenic epitopes as compared to a reference molecule. For certain embodiments, "de-immunized" means a molecule exhibited reduced antigenicity and/or immunogenicity after administration to a mammal as compared to a "parental" molecule from which it was derived, such as, e.g., a wild-type Shiga toxin A1 fragment. In certain embodiments, the de-immunized, Shiga toxin effector polypeptide of the present invention is capable of exhibiting a relative antigenicity compared to a reference molecule which is reduced by 10%, 20%, 30%, 40%, 50%, 60%, 70%, 80%, 90%, or greater than the antigenicity of the reference molecule under the same conditions measured by the same assay, such as, e.g., an assay known to the skilled worker and/or described herein like a quantitative ELISA or Western blot analysis. In certain embodiments, the de-immunized, Shiga toxin effector polypeptide of the present invention is capable of exhibiting a relative immunogenicity compared to a reference molecule which is reduced by 10%, 20%, 30%, 40%, 50%, 60%, 70%, 80%, 90%, 95%, 97%, 99%, or greater than the immunogenicity of the reference molecule under the same conditions measured by the same assay, such as, e.g., an assay known to the skilled worker and/or described herein like a quantitative measurement of anti-molecule antibodies produced in a mammal(s) after receiving parenteral administration of the molecule at a given time-point.

The relative immunogenicities of exemplary cell-targeting molecules were determined using an assay for in vivo antibody responses to the cell-targeting molecules after repeat, parenteral administrations over periods of many.

For purposes of the present invention, the phrase "B-cell and/or CD4+ T-cell de-immunized" means that the molecule has a reduced antigenic and/or immunogenic potential after administration to a mammal regarding either B-cell antigenicity or immunogenicity and/or CD4+ T-cell antigenicity or immunogenicity. For certain embodiments, "B-cell de-immunized" means a molecule exhibited reduced B-cell antigenicity and/or immunogenicity after administration to a mammal as compared to a "parental" molecule from which it was derived, such as, e.g., a wild-type Shiga toxin A1 fragment. For certain embodiments, "CD4+ T-cell de-immunized" means a molecule exhibited reduced CD4 T-cell antigenicity and/or immunogenicity after administration to a mammal as compared to a "parental" molecule from which it was derived, such as, e.g., a wild-type Shiga toxin A1 fragment.

The term "endogenous" with regard to a B-cell epitope, CD4+ T-cell epitope, B-cell epitope region, or CD4+ T-cell epitope region in a Shiga toxin effector polypeptide refers to an epitope present in a wild-type Shiga toxin A Subunit.

For purposes of the present invention, the phrase "CD8+ T-cell hyper-immunized" means that the molecule, when present inside a nucleated, chordate cell within a living chordate, has an increased antigenic and/or immunogenic potential regarding CD8+ T-cell antigenicity or immunogenicity. Commonly, CD8+ T-cell immunized molecules are capable of cellular internalization to an early endosomal compartment of a nucleated, chordate cell due either to an inherent feature(s) or as a component of a cell-targeting molecule.

For purposes of the present invention, the term "heterologous" means of a different source than an A Subunit of a naturally occurring Shiga toxin, e.g. a heterologous polypeptide is not naturally found as part of any A Subunit of a native Shiga toxin. The term "heterologous" with regard to T-cell epitope or T-cell epitope-peptide component of a polypeptide of the present invention refers to an epitope or peptide sequence which did not initially occur in the polypeptide to be modified, but which has been added to the polypeptide, whether added via the processes of embedding, fusion, insertion, and/or amino acid substitution as described herein, or by any other engineering means. The result is a modified polypeptide comprising a T-cell epitope foreign to the original, unmodified polypeptide, i.e. the T-cell epitope was not present in the original polypeptide.

The term "embedded" and grammatical variants thereof with regard to a T-cell epitope or T-cell epitope-peptide component of a polypeptide of the present invention refers to the internal replacement of one or more amino acids within a polypeptide region with different amino acids in order to generate a new polypeptide sequence sharing the same total number of amino acid residues with the starting polypeptide region. Thus, the term "embedded" does not include any external, terminal fusion of any additional amino acid, peptide, or polypeptide component to the starting polypeptide nor any additional internal insertion of any additional amino acid residues, but rather includes only substitutions for existing amino acids. The internal replacement may be accomplished merely by amino acid residue substitution or by a series of substitutions, deletions, insertions, and/or inversions. If an insertion of one or more amino acids is used, then the equivalent number of proximal amino acids must be deleted next to the insertion to result in an embedded T-cell epitope. This is in contrast to use of the term "inserted" with regard to a T-cell epitope contained within a polypeptide of the present invention to refer to the insertion of one or more amino acids internally within a polypeptide resulting in a new polypeptide having an increased number of amino acids residues compared to the starting polypeptide.

The term "inserted" and grammatical variants thereof with regard to a T-cell epitope contained within a polypeptide of the present invention refers to the insertion of one or more amino acids within a polypeptide resulting in a new polypeptide sequence having an increased number of amino acids residues compared to the starting polypeptide. The "pure" insertion of a T-cell epitope-peptide is when the resulting polypeptide increased in length by the number of amino acid residues equivalent to the number of amino acid residues in the entire, inserted T-cell epitope-peptide. The phrases "partially inserted," "embedded and inserted," and grammatical variants thereof with regard to a T-cell epitope contained within a polypeptide of the present invention, refers to when the resulting polypeptide increased in length, but by less than the number of amino acid residues equivalent to the length of the entire, inserted T-cell epitope-peptide. Insertions, whether "pure" or "partial," include any of the previously described insertions even if other regions of the polypeptide not proximal to the insertion site within the polypeptide are deleted thereby resulting in a decrease in the total length of the final polypeptide because the final polypeptide still comprises an internal insertion of one or more amino acids of a T-cell epitope-peptide within a polypeptide region.

As used herein, the term "T-cell epitope delivering" when describing a functional activity of a molecule means that a molecule provides the biological activity of localizing within a cell to a subcellular compartment that is competent to result in the proteasomal cleavage of a proteinaceous part of the molecule which comprises a T-cell epitope-peptide. The "T-cell epitope delivering" function of a molecule can be assayed by observing the MHC presentation of a T-cell epitope-peptide cargo of the molecule on a cell surface of a cell exogenously administered the molecule or in which the assay was begun with the cell containing the molecule in one or more of its endosomal compartments. Generally, the ability of a molecule to deliver a T-cell epitope to a proteasome can be determined where the initial location of the "T-cell epitope delivering" molecule is an early endosomal compartment of a cell, and then, the molecule is empirically shown to deliver the epitope-peptide to the proteasome of the cell. However, a "T-cell epitope delivering" ability may also be determined where the molecule starts at an extracellular location and is empirically shown, either directly or indirectly, to deliver the epitope into a cell and to proteasomes of the cell. For example, certain "T-cell epitope delivering" molecules pass through an endosomal compartment of the cell, such as, e.g. after endocytotic entry into that cell. Alternatively, "T-cell epitope delivering" activity may be observed for a molecule starting at an extracellular location whereby the molecule does not enter any endosomal compartment of a cell-instead the "T-cell epitope delivering" molecule enters a cell and delivers a T-cell epitope-peptide to proteasomes of the cell, presumably because the "T-cell epitope delivering" molecule directed its own routing to a subcellular compartment competent to result in proteasomal cleavage of its T-cell epitope-peptide component.

For purposes of the present invention, the phrase "proximal to an amino-terminus" with reference to the position of a Shiga toxin effector polypeptide region of a cell-targeting molecule of the present invention refers to a distance wherein at least one amino acid residue of the Shiga toxin effector polypeptide region is within 1, 2, 3, 4, 5, 6, 7, 8, 9, 10, 11, 12 or more, e.g., up to 18-20 amino acid residues, of an amino-terminus of the cell-targeting molecule as long as the cell-targeting molecule is capable of exhibiting the appropriate level of Shiga toxin effector functional activity noted herein (e.g., a certain level of cytotoxic potency). Thus for certain embodiments of the present invention, any amino acid residue(s) fused amino-terminal to the Shiga toxin effector polypeptide should not reduce any Shiga toxin effector function (e.g., by sterically hindering a structure(s) near the amino-terminus of the Shiga toxin effector polypeptide region) such that a functional activity of the Shiga toxin effector polypeptide is reduced below the appropriate activity level required herein.

For purposes of the present invention, the phrase "more proximal to an amino-terminus" with reference to the position of a Shiga toxin effector polypeptide region within a cell-targeting molecule of the present invention as compared to another component (e.g., a cell-targeting, binding region, molecular moiety, and/or additional exogenous material) refers to a position wherein at least one amino acid residue of the amino-terminus of the Shiga toxin effector polypeptide is closer to the amino-terminus of a linear, polypeptide component of the cell-targeting molecule of the present invention as compared to the other referenced component.

For purposes of the present invention, the phrase "active enzymatic domain derived from one A Subunit of a member of the Shiga toxin family" refers to having the ability to inhibit protein synthesis via a catalytic ribosome inactivation mechanism. The enzymatic activities of naturally occurring Shiga toxins may be defined by the ability to inhibit protein translation using assays known to the skilled worker, such as, e.g., in vitro assays involving RNA translation in the absence of living cells or in vivo assays involving RNA translation in a living cell. Using assays known to the skilled worker and/or described herein, the potency of a Shiga toxin enzymatic activity may be assessed directly by observing N-glycosidase activity toward ribosomal RNA (rRNA), such as, e.g., a ribosome nicking assay, and/or indirectly by observing inhibition of ribosome function and/or protein synthesis.

For purposes of the present invention, the term "Shiga toxin A1 fragment region" refers to a polypeptide region consisting essentially of a Shiga toxin A1 fragment and/or derived from a Shiga toxin A1 fragment of a Shiga toxin.

For purposes of the present invention, the terms "terminus," "amino-terminus," or "carboxy-terminus" with regard to a cell-targeting molecule refers generally to the last amino acid residue of a polypeptide chain of the cell-targeting molecule (e.g., a single, continuous polypeptide chain). A cell-targeting molecule may comprise more than one polypeptides or proteins, and, thus, a cell-targeting molecule of the present invention may comprise multiple amino-terminals and carboxy-terminals. For example, the "amino-terminus" of a cell-targeting molecule may be defined by the first amino acid residue of a polypeptide chain representing the amino-terminal end of the polypeptide, which is generally characterized by a starting, amino acid residue which does not have a peptide bond with any amino acid residue involving the primary amino group of the starting amino acid residue or involving the equivalent nitrogen for starting amino acid residues which are members of the class of N-alkylated alpha amino acid residues. Similarly, the "carboxy-terminus" of a cell-targeting molecule may be defined by the last amino acid residue of a polypeptide chain representing the carboxyl-terminal end of the polypeptide, which is generally characterized by a final, amino acid residue which does not have any amino acid residue linked by a peptide bond to the alpha-carbon of its primary carboxyl group.

For purposes of the present invention, the terms "terminus," "amino-terminus," or "carboxy-terminus" with regard to a polypeptide region refers to the regional boundaries of that region, regardless of whether additional amino acid residues are linked by peptide bonds outside of that region. In other words, the terminals of the polypeptide region regardless of whether that region is fused to other peptides or polypeptides. For example, a fusion protein comprising two proteinaceous regions, e.g., a binding region comprising a peptide or polypeptide and a Shiga toxin effector polypeptide, may have a Shiga toxin effector polypeptide region with a carboxy-terminus ending at amino acid residue 251 of the Shiga toxin effector polypeptide region despite a peptide bond involving residue 251 to an amino acid residue at position 252 representing the beginning of another proteinaceous region, e.g., the binding region. In this example, the carboxy-terminus of the Shiga toxin effector polypeptide region refers to residue 251, which is not a terminus of the fusion protein but rather represents an internal, regional boundary. Thus, for polypeptide regions, the terms "terminus," "amino-terminus," and "carboxy-terminus" are used to refer to the boundaries of polypeptide regions, whether the boundary is a physically terminus or an internal, position embedded within a larger polypeptide chain.

For purposes of the present invention, the phrase "carboxy-terminus region of a Shiga toxin A1 fragment" refers to a polypeptide region derived from a naturally occurring Shiga toxin A1 fragment, the region beginning with a hydrophobic residue (e.g., V236 of StxA-A1 and SLT-1A1, and V235 of SLT-2A1) that is followed by a hydrophobic residue and the region ending with the furin-cleavage site conserved among Shiga toxin A1 fragment polypeptides and ending at the junction between the A1 fragment and the A2 fragment in native, Shiga toxin A Subunits. For purposes of the present invention, the carboxy-terminal region of a Shiga toxin A1 fragment includes a peptidic region derived from the carboxy-terminus of a Shiga toxin A1 fragment polypeptide, such as, e.g., a peptidic region comprising or consisting essentially of the carboxy-terminus of a Shiga toxin A1 fragment. Non-limiting examples of peptidic regions derived from the carboxy-terminus of a Shiga toxin A1 fragment include the amino acid residue sequences natively positioned from position 236 to position 239, 240, 241, 242, 243, 244, 245, 246, 247, 248, 249, 250, or 251 in Stx1A (SEQ ID NO:2) or SLT-1A (SEQ ID NO:1); and from position 235 to position 239, 240, 241, 242, 243, 244, 245, 246, 247, 248, 249, or 250 in SLT-2A (SEQ ID NO:3).

For purposes of the present invention, the phrase "proximal to the carboxy-terminus of an A1 fragment polypeptide" with regard to a linked molecular moiety and/or binding region refers to being within 1, 2, 3, 4, 5, 6, 7, 8, 9, 10, 11, or 12 amino acid residues from the amino acid residue defining the last residue of the Shiga toxin A1 fragment polypeptide.

For purposes of the present invention, the phrase "sterically covers the carboxy-terminus of the A1 fragment-derived region" includes any molecular moiety of a size of 4.5 kDa or greater (e.g., an immunoglobulin-type binding region) linked and/or fused to an amino acid residue in the carboxy-terminus of the A1 fragment-derived region, such as, e.g., the amino acid residue derived from the amino acid residue natively positioned at any one of positions 236 to 251 in Stx1A (SEQ ID NO:2) or SLT-1A (SEQ ID NO:1) or from 235 to 250 in SLT-2A (SEQ ID NO:3). For purposes of the present invention, the phrase "sterically covers the carboxy-terminus of the A1 fragment-derived region" also includes any molecular moiety of a size of 4.5 kDa or greater (e.g., an immunoglobulin-type binding region) linked and/or fused to an amino acid residue in the carboxy-terminus of the A1 fragment-derived region, such as, e.g., the amino acid residue carboxy-terminal to the last amino acid A1 fragment-derived region and/or the Shiga toxin effector polypeptide. For purposes of the present invention, the phrase "sterically covers the carboxy-terminus of the A1 fragment-derived region" also includes any molecular moiety of a size of 4.5 kDa or greater (e.g., an immunoglobulin-type binding region) physically preventing cellular recognition of the carboxy-terminus of the A1 fragment-derived region, such as, e.g. recognition by the ERAD machinery of a eukaryotic cell.

For purposes of the present invention, a binding region, such as, e.g., an immunoglobulin-type binding region, that comprises a polypeptide comprising at least forty amino acids and that is linked (e.g., fused) to the carboxy-terminus of the Shiga toxin effector polypeptide region comprising an A1 fragment-derived region is a molecular moiety which is "sterically covering the carboxy-terminus of the A1 fragment-derived region."

For purposes of the present invention, a binding region, such as, e.g., an immunoglobulin-type binding region, that comprises a polypeptide comprising at least forty amino acids and that is linked (e.g., fused) to the carboxy-terminus of the Shiga toxin effector polypeptide region comprising an A1 fragment-derived region is a molecular moiety "encumbering the carboxy-terminus of the A1 fragment-derived region."

For purposes of the present invention, the term "A1 fragment of a member of the Shiga toxin family" refers to the remaining amino-terminal fragment of a Shiga toxin A Subunit after proteolysis by furin at the furin-cleavage site conserved among Shiga toxin A Subunits and positioned between the A1 fragment and the A2 fragment in wild-type Shiga toxin A Subunits.

For purposes of the claimed invention, the phrase "furin-cleavage motif at the carboxy-terminus of the A1 fragment region" refers to a specific, furin-cleavage motif conserved among Shiga toxin A Subunits and bridging the junction between the A1 fragment and the A2 fragment in naturally occurring, Shiga toxin A Subunits.

For purposes of the present invention, the phrase "furin-cleavage site proximal to the carboxy-terminus of the A1 fragment region" refers to any identifiable, furin-cleavage site having an amino acid residue within a distance of less than 1, 2, 3, 4, 5, 6, 7, or more amino acid residues of the amino acid residue defining the last amino acid residue in the A1 fragment region or A1 fragment derived region, including a furin-cleavage motif located carboxy-terminal of an A1 fragment region or A1 fragment derived region, such as, e.g., at a position proximal to the linkage of the A1 fragment-derived region to another component of the molecule, such as, e.g., a molecular moiety of a cell-targeting molecule of the present invention.

For purposes of the present invention, the phrase "disrupted furin-cleavage motif" refers to (i) a specific furin-cleavage motif as described herein in Section I-B and (ii) which comprises a mutation and/or truncation that can confer a molecule with a reduction in furin-cleavage as compared to a reference molecule, such as, e.g., a reduction in furin-cleavage reproducibly observed to be 30%, 40%, 50%, 60%, 70%, 80%, 90%, 95%, 97%, 98%, 99%, or less (including 100% for no cleavage) than the furin-cleavage of a reference molecule observed in the same assay under the same conditions. The percentage of furin-cleavage as compared to a reference molecule can be expressed as a ratio of cleaved:uncleaved material of the molecule of interest divided by the cleaved:uncleaved material of the reference molecule (see Examples, supra). Non-limiting examples of suitable reference molecules include certain molecules comprising a wild-type Shiga toxin furin-cleavage motif and/or furin-cleavage site as described herein in Section I-B, Section IV-B, and/or the Examples) and/or molecules used as reference molecules in the Examples below.

For purposes of the present invention, the phrase "furin-cleavage resistant" means a molecule or specific polypeptide region thereof exhibits reproducibly less furin cleavage than (i) the carboxy-terminus of a Shiga toxin A1 fragment in a wild-type Shiga toxin A Subunit or (ii) the carboxy-terminus of the Shiga toxin A1 fragment derived region of construct wherein the naturally occurring furin-cleavage site natively positioned at the junction between the A1 and A2 fragments is not disrupted; as assayed by any available means to the skilled worker, including by using a method described herein.

For purposes of the present invention, the phrase "active enzymatic domain derived form an A Subunit of a member of the Shiga toxin family" refers to a polypeptide structure having the ability to inhibit protein synthesis via catalytic inactivation of a ribosome based on a Shiga toxin enzymatic activity. The ability of a molecular structure to exhibit inhibitory activity of protein synthesis and/or catalytic inactivation of a ribosome may be observed using various assays known to the skilled worker, such as, e.g., in vitro assays involving RNA translation assays in the absence of living cells or in vivo assays involving the ribosomes of living cells. For example, using assays known to the skilled worker, the enzymatic activity of a molecule based on a Shiga toxin enzymatic activity may be assessed directly by observing N-glycosidase activity toward ribosomal RNA (rRNA), such as, e.g., a ribosome nicking assay, and/or indirectly by observing inhibition of ribosome function, RNA translation, and/or protein synthesis.

As used herein with respect to a Shiga toxin effector polypeptide, a "combination" describes a Shiga toxin effector polypeptide comprising two or more sub-regions wherein each sub-region comprises at least one of the following: (1) a disruption in an endogenous epitope or epitope region; (2) an embedded, heterologous, T-cell epitope-peptide; (3) an inserted, heterologous, T-cell epitope-peptide; and (4) a disrupted furin-cleavage motif at the carboxy-terminus of an A1 fragment region.

Introduction

The present invention provides various, combination, Shiga toxin effector polypeptides and cell-targeting molecules comprising the same. Certain embodiments of the Shiga toxin effector polypeptides of the present invention combine structural elements resulting in two or more properties in a single molecule, such as, e.g., the ability to 1) exhibit reduced antigenicity and/or immunogenicity as compared to molecular variants lacking that particular combination of elements, 2) exhibit reduced protease-cleavage as compared to molecular variants lacking that particular combination of elements, 3) exhibit reduced non-specific toxicity to a multicellular organism at certain dosages as compared to molecular variants lacking that particular combination of elements, 4) deliver an embedded or inserted T-cell epitope to the MHC class I system a cell for cell-surface presentation, and/or 5) exhibit potent cytotoxicity. The Shiga toxin effector polypeptides of the present invention may serve as scaffolds to create various cell-targeting molecules, such as, e.g., cell-targeted, cytotoxic, therapeutic molecules; cell-targeted, nontoxic, delivery vehicles; and cell-targeted, diagnostic molecules.

I. The General Structures of the Shiga Toxin Effector Polypeptides of the Invention The Shiga toxin effector polypeptides and cell-targeting molecules of the present invention comprise at least one, Shiga toxin effector polypeptide derived from wild-type Shiga toxin A Subunits but comprise one or more structural modifications, such as, e.g., a mutation like a truncation and/or amino acid residue substitution(s). For certain embodiments, the present invention involves the engineering of improved, Shiga toxin A Subunit effector polypeptides comprising the combination of two or more of the following Shiga toxin effector polypeptide sub-regions: (1) a de-immunized sub-region, (2) a protease-cleavage resistant sub-region near the carboxy-terminus of a Shiga toxin A1 fragment region, and (3) a T-cell epitope-peptide embedded or inserted sub-region.

A Shiga toxin effector polypeptide is a polypeptide derived from a Shiga toxin A Subunit member of the Shiga toxin family that is capable of exhibiting one or more Shiga toxin functions (see e.g., Cheung M et al., *Mol Cancer* 9: 28 (2010); WO 2014/164693; WO 2015/113005; WO 2015/113007; WO 2015/138452; WO 2015/191764). Shiga toxin functions include, e.g., increasing cellular internalization, directing subcellular routing from an endosomal compartment to the cytosol, avoiding intracellular degradation, catalytically inactivating ribosomes, and effectuating cytostatic and/or cytotoxic effects.

The Shiga toxin family of protein toxins is composed of various naturally occurring toxins which are structurally and functionally related, e.g., Shiga toxin, Shiga-like toxin 1, and Shiga-like toxin 2 (Johannes L, Römer W, *Nat Rev Microbiol* 8: 105-16 (2010)). Holotoxin members of the Shiga toxin family contain targeting domains that preferentially bind a specific glycosphingolipid present on the surface of some host cells and an enzymatic domain capable of permanently inactivating ribosomes once inside a cell (Johannes L, Römer W, *Nat Rev Microbiol* 8: 105-16 (2010)). Members of the Shiga toxin family share the same overall structure and mechanism of action (Engedal N et al., *Microbial Biotech* 4: 32-46 (2011)). For example, Stx, SLT-1 and SLT-2 display indistinguishable enzymatic activity in cell free systems (Head S et al., *J Biol Chem* 266: 3617-21 (1991); Tesh V et al., *Infect Immun* 61: 3392-402 (1993); Brigotti M et al., *Toxicon* 35:1431-1437 (1997)).

The Shiga toxin family encompasses true Shiga toxin (Stx) isolated from *S. dysenteriae* serotype 1, Shiga-like toxin 1 variants (SLT1 or Stx1 or SLT-1 or Slt-I) isolated from serotypes of enterohemorrhagic *E. coli*, and Shiga-like toxin 2 variants (SLT2 or Stx2 or SLT-2) isolated from serotypes of enterohemorrhagic *E. coli*. SLT1 differs by only one amino acid residue from Stx, and both have been referred to as Verocytotoxins or Verotoxins (VTs) (O'Brien A, *Curr Top Microbiol Immunol* 180: 65-94 (1992)). Although SLT1 and SLT2 variants are only about 53-60% similar to each other at the primary amino acid sequence level, they share mechanisms of enzymatic activity and cytotoxicity common to the members of the Shiga toxin family (Johannes L, Römer W, *Nat Rev Microbiol* 8: 105-16 (2010)). Over 39 different Shiga toxins have been described, such as the defined subtypes Stx1a, Stx1c, Stx1d, and Stx2a-g (Scheutz F et al., *J Clin Microbiol* 50: 2951-63 (2012)). Members of the Shiga toxin family are not naturally restricted to any bacterial species because Shiga-toxin-encoding genes can spread among bacterial species via horizontal gene transfer (Strauch E et al., *Infect Immun* 69: 7588-95 (2001); Bielaszewska M et al., *Appl Environ Micrbiol* 73: 3144-50 (2007); Zhaxybayeva O, Doolittle W, *Curr Biol* 21: R242-6 (2011)). As an example of interspecies transfer, a Shiga toxin was discovered in a strain of *A. haemolyticus* isolated from a patient (Grotiuz G et al., *J Clin Microbiol* 44: 3838-41 (2006)). Once a Shiga toxin encoding polynucleotide enters a new subspecies or species, the Shiga toxin amino acid sequence is presumed to be capable of developing slight sequence variations due to genetic drift and/or selective pressure while still maintaining a mechanism of cytotoxicity common to members of the Shiga toxin family (see Scheutz F et al., *J Clin Microbiol* 50: 2951-63 (2012)).

A. De-Immunized, Shiga Toxin A Subunit Effector Polypeptides

In certain embodiments, the Shiga toxin effector polypeptide of the present invention is de-immunized, such as, e.g., as compared to a wild-type Shiga toxin, wild-type Shiga toxin polypeptide, and/or Shiga toxin effector polypeptide comprising only wild-type polypeptide sequences. The de-immunized, Shiga toxin effector polypeptides of the present invention each comprise a disruption of at least one, putative, endogenous, epitope region in order to reduce the antigenic and/or immunogenic potential of the Shiga toxin effector polypeptide after administration of the polypeptide to a chordate. A Shiga toxin effector polypeptide and/or Shiga toxin A Subunit polypeptide, whether naturally occurring or not, can be de-immunized by a method described herein, described in WO 2015/113005 and/or WO 2015/113007, and/or known to the skilled worker, wherein the resulting molecule retains one or more Shiga toxin A Subunit functions.

In certain embodiments, the Shiga toxin effector polypeptide of the present invention comprises a disruption of an endogenous epitope or epitope region, such as, e.g., a B-cell and/or CD4+ T-cell epitope. In certain embodiments, the Shiga toxin effector polypeptide of the present invention comprises a disruption of at least one, endogenous, epitope region described herein, wherein the disruption reduces the antigenic and/or immunogenic potential of the Shiga toxin effector polypeptide after administration of the polypeptide to a chordate, and wherein the Shiga toxin effector polypeptide is capable of exhibiting one or more Shiga toxin A Subunit functions, such as, e.g., a significant level of Shiga toxin cytotoxicity.

The term "disrupted" or "disruption" as used herein with regard to an epitope region refers to the deletion of at least one amino acid residue in an epitope region, inversion of two or more amino acid residues where at least one of the inverted amino acid residues is in an epitope region, insertion of at least one amino acid into an epitope region, and a substitution of at least one amino acid residue in an epitope region. An epitope region disruption by mutation includes amino acid substitutions with non-standard amino acids and/or non-natural amino acids. Epitope regions may alternatively be disrupted by mutations comprising the modification of an amino acid by the addition of a covalently-linked chemical structure which masks at least one amino acid in an epitope region, see, e.g. PEGylation (see Zhang C et al., *BioDrugs* 26: 209-15 (2012), small molecule adjuvants (Flower D, *Expert Opin Drug Discov* 7: 807-17 (2012), and site-specific albumination (Lim S et al., *J Control Release* 207-93 (2015)).

Certain epitope regions and disruptions are indicated herein by reference to specific amino acid positions of native Shiga toxin A Subunits provided in the Sequence Listing, noting that naturally occurring Shiga toxin A Subunits may comprise precursor forms containing signal sequences of about 22 amino acids at their amino-terminals which are removed to produce mature Shiga toxin A Subunits and are recognizable to the skilled worker. Further, certain epitope region disruptions are indicated herein by reference to specific amino acids (e.g. S for a serine residue) natively present at specific positions within native Shiga toxin A Subunits (e.g. S33 for the serine residue at position 33 from the amino-terminus) followed by the amino acid with which that residue has been substituted in the particular mutation under discussion (e.g. S33I represents the amino acid substitution of isoleucine for serine at amino acid residue 33 from the amino-terminus).

In certain embodiments, the de-immunized, Shiga toxin effector polypeptide of the present invention comprises a disruption of at least one epitope region provided herein (see e.g. Tables 1-7 and/or 12). In certain embodiments, the de-immunized, Shiga toxin effector polypeptide of the present invention comprises a disruption of at least one epitope region described in WO 2015/113005 or WO 2015/113007.

In certain embodiments, the de-immunized, Shiga toxin effector polypeptide of the present invention comprises or consists essentially of a full-length Shiga toxin A Subunit (e.g. SLT-1A (SEQ ID NO:1), StxA (SEQ ID NO:2), or SLT-2A (SEQ ID NO:3)) comprising at least one disruption of the amino acid sequence selected from the group of natively positioned amino acids consisting of: 1-15 of SEQ ID NO:1 or SEQ ID NO:2; 3-14 of SEQ ID NO:3; 26-37 of SEQ ID NO:3; 27-37 of SEQ ID NO:1 or SEQ ID NO:2; 39-48 of SEQ ID NO:1 or SEQ ID NO:2; 42-48 of SEQ ID NO:3; 53-66 of SEQ ID NO:1, SEQ ID NO:2, or SEQ ID NO:3; 94-115 of SEQ ID NO:1, SEQ ID NO:2, or SEQ ID NO:3; 141-153 of SEQ ID NO:1 or SEQ ID NO:2; 140-156 of SEQ ID NO:3; 179-190 of SEQ ID NO:1 or SEQ ID NO:2; 179-191 of SEQ ID NO:3; 204 of SEQ ID NO:3; 205 of SEQ ID NO:1 or SEQ ID NO:2; 210-218 of SEQ ID NO:3; 240-258 of SEQ ID NO:3; 243-257 of SEQ ID NO:1 or SEQ ID NO:2; 254-268 of SEQ ID NO:1 or SEQ ID NO:2; 262-278 of SEQ ID NO:3; 281-297 of SEQ ID NO:3; and 285-293 of SEQ ID NO:1 or SEQ ID NO:2, or the equivalent position in a Shiga toxin A Subunit polypeptide, conserved Shiga toxin effector polypeptide sub-region, and/or non-native, Shiga toxin effector polypeptide sequence.

In certain embodiments, the Shiga toxin effector polypeptide of the present invention comprises or consists essentially of a truncated Shiga toxin A Subunit. Truncations of Shiga toxin A Subunits might result in the deletion of an entire epitope region(s) without affecting Shiga toxin effector function(s). The smallest, Shiga toxin A Subunit fragment shown to exhibit significant enzymatic activity was a polypeptide composed of residues 75-247 of StxA (Al-Jaufy A et al., *Infect Immun* 62: 956-60 (1994)). Truncating the carboxy-terminus of SLT-1A, StxA, or SLT-2A to amino acids 1-251 removes two predicted B-cell epitope regions, two predicted CD4 positive (CD4+) T-cell epitopes, and a predicted, discontinuous, B-cell epitope. Truncating the amino-terminus of SLT-1A, StxA, or SLT-2A to 75-293 removes at least three, predicted, B-cell epitope regions and three predicted CD4+ T-cell epitopes. Truncating both amino- and carboxy-terminals of SLT-1A, StxA, or SLT-2A to 75-251 deletes at least five, predicted, B-cell epitope regions; four, putative, CD4+ T-cell epitopes; and one, predicted, discontinuous, B-cell epitope.

In certain embodiments, a Shiga toxin effector polypeptide of the invention may comprise or consist essentially of a full-length or truncated Shiga toxin A Subunit with at least one mutation, e.g. deletion, insertion, inversion, or substitution, in a provided epitope region. In certain further embodiments, the polypeptides comprise a disruption which comprises a deletion of at least one amino acid within the epitope region. In certain further embodiments, the polypeptides comprise a disruption which comprises an insertion of at least one amino acid within the epitope region. In certain further embodiments, the polypeptides comprise a disruption which comprises an inversion of amino acids, wherein at least one inverted amino acid is within the epitope region. In certain further embodiments, the polypeptides comprise a disruption which comprises a mutation, such as an amino acid substitution to a non-standard amino acid or an amino acid with a chemically modified side chain. Numerous examples of single amino acid substitutions are provided in the Examples below.

In certain embodiments, the Shiga toxin effector polypeptides of the invention may comprise or consist essentially of a full-length or truncated Shiga toxin A Subunit with one or more mutations as compared to the native sequence which comprises at least one amino acid substitution selected from the group consisting of: A, G, V, L, I, P, C, M, F, S, D, N, Q, H, and K. In certain further embodiments, the polypeptide may comprise or consist essentially of a full-length or truncated Shiga toxin A Subunit with a single mutation as compared to the native sequence wherein the substitution is selected from the group consisting of: D to A, D to G, D to V, D to L, D to I, D to F, D to S, D to Q, E to A, E to G, E to V, E to L, E to I, E to F, E to S, E to Q, E to N, E to D, E to M, E to R, G to A, H to A, H to G, H to V, H to L, H to I, H to F, H to M, K to A, K to G, K to V, K to L, K to I, K to M, K to H, L to A, L to G, N to A, N to G, N to V, N to L, N to I, N to F, P to A, P to G, P to F, R to A, R to G, R to V, R to L, R to I, R to F, R to M, R to Q, R to S, R to K, R to H, S to A, S to G, S to V, S to L, S to I, S to F, S to M, T to A, T to G, T to V, T to L, T to I, T to F, T to M, T to S, Y to A, Y to G, Y to V, Y to L, Y to I, Y to F, and Y to M.

In certain embodiments, the Shiga toxin effector polypeptides of the invention comprise or consist essentially of a full-length or truncated Shiga toxin A Subunit with one or more mutations as compared to the native amino acid residue sequence which comprises at least one amino acid substitution of an immunogenic residue and/or within an epitope region, wherein at least one substitution occurs at the natively positioned group of amino acids selected from the group consisting of: 1 of SEQ ID NO:1 or SEQ ID NO:2; 4 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 44 of SEQ ID NO:1 or SEQ ID NO:2; 45 of SEQ ID NO:1 or SEQ ID NO:2; 46 of SEQ ID NO:1 or SEQ ID NO:2; 47 of SEQ ID NO:1 or SEQ ID NO:2; 48 of SEQ ID NO:1, SEQ ID NO:2, or SEQ ID NO:3; 49 of SEQ ID NO:1 or SEQ ID NO:2; 50 of SEQ ID NO:1 or SEQ ID NO:2; 51 of SEQ ID NO:1 or SEQ ID NO:2; 53 of SEQ ID NO:1 or SEQ ID NO:2; 54 of SEQ ID NO:1 or SEQ ID NO:2; 55 of SEQ ID NO:1 or SEQ ID NO:2; 56 of SEQ ID NO:1 or SEQ ID NO:2; 57 of SEQ ID NO:1 or SEQ ID NO:2; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 84 of SEQ ID NO:1 or SEQ ID NO:2; 88 of SEQ ID NO:1 or SEQ ID NO:2; 94 of SEQ ID NO:1, SEQ ID NO:2, or SEQ ID NO:3; 96 of SEQ ID NO:1, SEQ ID NO:2, or SEQ ID NO:3; 104 of SEQ ID NO:1 or SEQ ID NO:2; 105 of SEQ ID NO:1 or SEQ ID NO:2; 107 of SEQ ID NO:1 or SEQ ID NO:2; 108 of SEQ ID NO:1 or SEQ ID NO:2; 109 of SEQ ID NO:1, SEQ ID NO:2, or SEQ ID NO:3; 110 of SEQ ID NO:1 or SEQ ID NO:2; 111 of SEQ ID NO:1 or SEQ ID NO:2; 112 of SEQ ID NO:1, SEQ ID NO:2, or SEQ ID NO:3; 141 of SEQ ID NO:1 or SEQ ID NO:2; 147 of SEQ ID NO:1, SEQ ID NO:2, or SEQ ID NO:3; 154 of SEQ ID NO:1 or SEQ ID NO:2; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 198 of SEQ ID NO:1 or SEQ ID NO:2; 204 of SEQ ID NO:3; 205 of SEQ ID NO:1 or SEQ ID NO:2; 241 of SEQ ID NO:3; 242 of SEQ ID NO:1 or SEQ ID NO:2; 247 of SEQ ID NO:1 or SEQ ID NO:2; 247 of SEQ ID NO:3; 248 of SEQ ID NO:1 or SEQ ID NO:2; 250 of SEQ ID NO:3; 251 of SEQ ID NO:1 or SEQ ID NO:2; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2.

In certain further embodiments, the Shiga toxin effector polypeptides of the invention comprise or consist essentially of a full-length or truncated Shiga toxin A Subunit with at least one substitution of an immunogenic residue and/or within an epitope region, wherein at least one amino acid substitution is to a non-conservative amino acid (see, e.g., Table C, infra) relative to a natively occurring amino acid positioned at one of the following native positions: 1 of SEQ ID NO:1 or SEQ ID NO:2; 4 of SEQ ID NO:1, SEQ ID NO:2, or SEQ ID NO:3; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 44 of SEQ ID NO:1 or SEQ ID NO:2; 45 of SEQ ID NO:1 or SEQ ID NO:2; 46 of SEQ ID NO:1 or SEQ ID NO:2; 47 of SEQ ID NO:1 or SEQ ID NO:2; 48 of SEQ ID NO:1, SEQ ID NO:2, or SEQ ID NO:3; 49 of SEQ ID NO:1 or SEQ ID NO:2; 50 of SEQ ID NO:1 or SEQ ID NO:2; 51 of SEQ ID NO:1 or SEQ ID NO:2; 53 of SEQ ID NO:1 or SEQ ID NO:2; 54 of SEQ ID NO:1 or SEQ ID NO:2; 55 of SEQ ID NO:1 or SEQ ID NO:2; 56 of SEQ ID NO:1 or SEQ ID NO:2; 57 of SEQ ID NO:1 or SEQ ID NO:2; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 84 of SEQ ID NO:1 or SEQ ID NO:2; 88 of SEQ ID NO:1 or SEQ ID NO:2; 94 of SEQ ID NO:1, SEQ ID NO:2, or SEQ ID NO:3; 96 of SEQ ID NO:1, SEQ ID NO:2, or SEQ ID NO:3; 104 of SEQ ID NO:1 or SEQ ID NO:2; 105 of SEQ ID NO:1 or SEQ ID NO:2; 107 of SEQ ID NO:1 or SEQ ID NO:2; 108 of SEQ ID NO:1 or SEQ ID NO:2; 109 of SEQ ID NO:1, SEQ ID NO:2, or SEQ ID NO:3; 110 of SEQ ID NO:1 or SEQ ID NO:2; 111 of SEQ ID NO:1 or SEQ ID NO:2; 112 of SEQ ID NO:1, SEQ ID NO:2, or SEQ ID NO:3; 141 of SEQ ID NO:1 or SEQ ID NO:2; 147 of SEQ ID NO:1, SEQ ID NO:2, or SEQ ID NO:3; 154 of SEQ ID NO:1 or SEQ ID NO:2; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 198 of SEQ ID NO:1 or SEQ ID NO:2; 204 of SEQ ID NO:3; 205 of SEQ ID NO:1 or SEQ ID NO:2; 241 of SEQ ID NO:3; 242 of SEQ ID NO:1 or SEQ ID NO:2; 247 of SEQ ID NO:1 or SEQ ID NO:2; 247 of SEQ ID NO:3; 248 of SEQ ID NO:1 or SEQ ID NO:2; 250 of SEQ ID NO:3; 251 of SEQ ID NO:1 or SEQ ID NO:2; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2.

In certain further embodiments, the Shiga toxin effector polypeptides of the invention comprise or consist essentially of a full-length or truncated Shiga toxin A Subunit with at least one amino acid substitution selected from the group consisting of: K1 to A, G, V, L, I, F, M and H; T4 to A, G, V, L, I, F, M, and S; D6 to A, G, V, L, I, F, S, and Q; S8 to A, G, V, I, L, F, and M; T8 to A, G, V, I, L, F, M, and S; T9 to A, G, V, I, L, F, M, and S; S9 to A, G, V, L, I, F, and M; K11 to A, G, V, L, I, F, M and H; T12 to A, G, V, I, L, F, M, and S; S33 to A, G, V, L, I, F, and M; S43 to A, G, V, L, I, F, and M; G44 to A and L; S45 to A, G, V, L, I, F, and M; T45 to A, G, V, L, I, F, and M; G46 to A and P; D47 to A, G, V, L, I, F, S, and Q; N48 to A, G, V, L, and M; L49 to A or G; F50; A51 to V; D53 to A, G, V, L, I, F, S, and Q; V54 to A, G, and L; R55 to A, G, V, L, I, F, M, Q, S, K, and H; G56 to A and P; 157 to A, G, M, and F; L57 to A, G, M, and F; D58 to A, G, V, L, I, F, S, and Q; P59 to A, G, and F; E60 to A, G, V, L, I, F, S, Q, N, D, M, and R; E61 to A, G, V, L, I, F, S, Q, N, D, M, and R; G62 to A; D94 to A, G, V, L, I, F, S, and Q; R84 to A, G, V, L, I, F, M, Q, S, K, and H; V88 to A and G; 188 to A, G, and V; D94; S96 to A, G, V, I, L, F, and M; T104 to A, G, V, I, L, F, M, and S; A105 to L; T107 to A, G, V, I, L, F, M, and S; S107 to A, G, V, L, I, F, and M; L108 to A, G, and M; S109 to A, G, V, I, L, F, and M; T109 to A, G, V, I, L, F, M, and S; G110 to A; D111 to A, G, V, L, I, F, S, and Q; S112 to A, G, V, L, I, F, and M; D141 to A, G, V, L, I, F, S, and Q; G147 to A; V154 to A and G; R179 to A, G, V, L, I, F, M, Q, S, K, and H; T180 to A, G, V, L, I, F, M, and S; T181 to A, G, V, L, I, F, M, and S; D183 to A, G, V, L, I, F, S, and Q; D184 to A, G, V, L, I, F, S, and Q; L185 to A, G, and V; S186 to A, G, V, I, L, F, and M; G187 to A; R188 to A, G, V, L, I, F, M, Q, S, K, and H; S189 to A, G, V, I, L, F, and M; D197 to A, G, V, L, I, F, S, and Q; D198 to A, G, V, L, I, F, S, and Q; R204 to A, G, V, L, I, F, M, Q, S, K, and H; R205 to A, G, V, L, I, F, M, Q, S, K and H; C242 to A, G, V, and S; S247 to A, G, V, I, L, F, and M; Y247 to A, G, V, L, I, F, and M; R248 to A, G, V, L, I, F, M, Q, S, K, and H; R250 to A, G, V, L, I, F, M, Q, S, K, and H; R251 to A, G, V, L, I, F, M, Q, S, K, and H; C262 to A, G, V, and S; D264 to A, G, V, L, I, F, S, and Q; G264 to A; and T286 to A, G, V, L, I, F, M, and S.

In certain further embodiments, the Shiga toxin effector polypeptides of the invention comprise or consist essentially of a full-length or truncated Shiga toxin A Subunit with at least one of the following amino acid substitutions K1A, K1M, T4I, D6R, S8I, T8V, T9I, S9I, K11A, K11H, T12K, S33I, S33C, S43N, G44L, S45V, S45I, T45V, T45I, G46P, D47M, D47G, N48V, N48F, L49A, F50T, A51V, D53A, D53N, D53G, V54L, V54I, R55A, R55V, R55L, G56P, I57F, I57M, D58A, D58V, D58F, P59A, P59F, E60I, E60T, E60R, E61A, E61V, E61L, G62A, R84A, V88A, D94A, S96I, T104N, A105L, T107P, L108M, S109V, T109V, G110A, D111T, S112V, D141A, G147A, V154A, R179A, T180G, T181I, D183A, D183G, D184A, D184A, D184F, L185V, L185D, S186A, S186F, G187A, G187T, R188A, R188L, S189A, D198A, R204A, R205A, C242S, S247I, Y247A, R248A, R250A, R251A, or D264A, G264A, T286A, and/or T286I. These epitope disrupting substitutions may be combined to form a de-immunized, Shiga toxin effector polypeptide with multiple substitutions per epitope region and/or multiple epitope regions disrupted while still retaining Shiga toxin effector function. For example, substitutions at the natively positioned K1A, K1M, T4I, D6R, S8I, T8V, T9I, S9I, K11A, K11H, T12K, S33I, S33C, S43N, G44L, S45V, S45I, T45V, T45I, G46P, D47M, D47G, N48V, N48F, L49A, F50T, A51V, D53A, D53N, D53G, V54L, V54I, R55A, R55V, R55L, G56P, I57F, I57M, D58A, D58V, D58F, P59A, P59F, E60I, E60T, E60R, E61A, E61V, E61L, G62A, R84A, V88A, D94A, S96I, T104N, A105L, T107P, L108M, S109V, T109V, G110A, D111T, S112V, D141A, G147A, V154A, R179A, T180G, T181, D183A, D183G, D184A, D184A, D184F, L185V, L185D, S186A, S186F, G187A, G187T, R188A, R188L, S189A, D198A, R204A, R205A, C242S, S247I, Y247A, R248A, R250A, R251A, or D264A, G264A, T286A, and/or T286I may be combined, where possible, with substitutions at the natively positioned residues K1A, K1M, T4I, D6R, S8I, T8V, T9I, S9I, K11A, K11H, T12K, S33I, S33C, S43N, G44L, S45V, S45I, T45V, T45I, G46P, D47M, D47G, N48V, N48F, L49A, F50T, A51V, D53A, D53N, D53G, V54L, V54I, R55A, R55V, R55L, G56P, I57F, I57M, D58A, D58V, D58F, P59A, P59F, E60I, E60T, E60R, E61A, E61V, E61L, G62A, R84A, V88A, D94A, S96I, T104N, A105L, T107P, L108M, S109V, T109V, G110A, D111T, S112V, D141A, G147A, V154A, R179A, T180G, T181I, D183A, D183G, D184A, D184A, D184F, L185V, L185D, S186A, S186F, G187A, G187T, R188A, R188L, S189A, D198A, R204A, R205A, C242S, S247I, Y247A, R248A, R250A, R251A, or D264A, G264A, T286A, and/or T286I to create de-immunized, Shiga toxin effector polypeptides of the invention.

Any of the de-immunized, Shiga toxin effector polypeptide sub-regions and/or epitope disrupting mutations described herein may be used alone or in combination with each individual embodiment of the present invention, including methods of the present invention.

B. Protease-Cleavage Resistant, Shiga Toxin A Subunit Effector Polypeptides

In certain embodiments, the Shiga toxin effector polypeptide of the present invention comprises (1) a Shiga toxin A1 fragment derived region having a carboxy-terminus and (2) a disrupted furin-cleavage motif at the carboxy-terminus of the Shiga toxin A1 fragment region. Improving the stability of connections between the Shiga toxin component and other components of cell-targeting molecules, e.g., cell-targeting binding regions, can improve their toxicity profiles after administration to organisms by reducing non-specific toxicities caused by the breakdown of the connection and loss of cell-targeting, such as, e.g., as a result of proteolysis.

Shiga toxin A Subunits of members of the Shiga toxin family comprise a conserved, furin-cleavage site at the carboxy-terminal of their A1 fragment regions important for Shiga toxin function. Furin-cleavage site motifs and furin-cleavage sites can be identified by the skilled worker using standard techniques and/or by using the information herein.

The model of Shiga toxin cytotoxicity is that intracellular proteolytic processing of Shiga toxin A Subunits by furin in intoxicated cells is essential for 1) liberation of the A1 fragment from the rest of the Shiga holotoxin, 2) escape of the A1 fragment from the endoplasmic reticulum by exposing a hydrophobic domain in the carboxy-terminus of the A1 fragment, and 3) enzymatic activation of the A1 fragment (see Johannes L, Römer W, *Nat Rev Microbiol* 8: 105-16 (2010)). The efficient liberation of the Shiga toxin A1 fragment from the A2 fragment and the rest of the components of the Shiga holotoxin in the endoplasmic reticulum of intoxicated cells is essential for efficient intracellular routing to the cytosol, maximal enzymatic activity, efficient ribosome inactivation, and achieving optimal cytotoxicity, i.e. comparable to a wild-type Shiga toxin (see e.g. WO 2015/191764 and references therein).

During Shiga toxin intoxication, the A Subunit is proteolytically cleaved by furin at the carboxy bond of a conserved arginine residue (e.g. the arginine residue at position 251 in StxA and SLT-1A and the arginine residue at position 250 in Stx2A and SLT-2A). Furin cleavage of Shiga toxin A Subunits occurs in endosomal and/or Golgi compartments. Furin is a specialized serine endoprotease which is expressed by a wide variety of cell types, in all human tissues examined, and by most animal cells. Furin cleaves polypeptides comprising accessible motifs often centered on the minimal, dibasic, consensus motif R-x-(R/K/x)-R. The A Subunits of members of the Shiga toxin family comprise a conserved, surface-exposed, extended loop structure (e.g. 242-261 in StxA and SLT-1A, and 241-260 in SLT-2) with a conserved S-R/Y-x-x-R motif which is cleaved by furin. The surface exposed, extended loop structure positioned at amino acid residues 242-261 in StxA is required for furin-induced cleavage of StxA, including features flanking the minimal, furin-cleavage motif R-x-x-R.

Furin-cleavage motifs and furin-cleavage sites in Shiga toxin A Subunits and Shiga toxin effector polypeptides can be identified by the skilled worker using standard methods and/or by using the information herein. Furin cleaves the minimal, consensus motif R-x-x-R (Schalken J et al., *J Clin Invest* 80: 1545-9 (1987); Bresnahan P et al., *J Cell Biol* 111: 2851-9 (1990); Hatsuzawa K et al., *J Biol Chem* 265: 22075-8 (1990); Wise R et al., *Proc Natl Acad Sci USA* 87: 9378-82 (1990); Molloy S et al., *J Biol Chem* 267: 16396-402 (1992)). Consistent with this, many furin inhibitors comprise peptides comprising the motif R-x-x-R. An example of a synthetic inhibitor of furin is a molecule comprising the peptide R-V-K-R (SEQ ID NO:537) (Henrich S et al., *Nat Struct Biol* 10: 520-6 (2003)). In general, a peptide or protein comprising a surface accessible, dibasic amino acid motif with two positively charged, amino acids separated by two amino acid residues may be predicted to be sensitive to furin-cleavage with cleavage occurring at the carboxy bond of the last basic amino acid in the motif.

Consensus motifs in substrates cleaved by furin have been identified with some degree of specificity. A furin-cleavage site motif has been described that comprises a region of twenty, continuous, amino acid residues, which can be labeled P14 through P6' (Tian S et al., *Int J Mol Sci* 12: 1060-5 (2011)) using the nomenclature described in Schechter I, Berger, A, *Biochem Biophys Res Commun* 32: 898-902 (1968). According to this nomenclature, the furin-cleavage site is at the carboxy bond of the amino acid residue designated P1, and the amino acid residues of the furin-cleavage motif are numbered P2, P3, P4, etc., in the direction going toward the amino-terminus from this reference P1 residue. The amino acid residues of the motif going toward the carboxy-terminus from the P1 reference residue are numbered with the prime notation P2', P3', P4', etc. Using this nomenclature, the P6 to P2' region delineates the core substrate of the furin cleavage motif which is bound by the enzymatic domain of furin. The two flanking regions P14 to P7 and P3' to P6' are often rich in polar, amino acid residues to increase the accessibility to the core furin cleavage site located between them.

A general, furin-cleavage site is often described by the consensus motif R-x-x-R which corresponds to P4-P3-P2-P1; where "R" represents an arginine residue (see Table A, supra), a dash "-" represents a peptide bond, and a lowercase "x" represents any amino acid residue. However, other residues and positions may help to further define furin-cleavage motifs. A slightly more refined furin-cleavage site, consensus motif is often reported as the consensus motif R-x-[K/R]-R (where a forward slash "/" means "or" and divides alternative amino acid residues at the same position), which corresponds to P4-P3-P2-P1, because it was observed that furin has a strong preference for cleaving substrates containing this motif.

In addition to the minimal, furin-cleavage site R-x-x-R, a larger, furin-cleavage motif has been described with certain amino acid residue preferences at certain positions. By comparing various known furin substrates, certain physicochemical properties have been characterized for the amino acids residues in a 20 amino acid residue long, furin-cleavage site motif. The P6 to P2' region of the furin-cleavage motif delineates the core furin-cleavage site which physically interacts with the enzymatic domain of furin. The two flanking regions P14 to P7 and P3' to P6' are often hydrophilic being rich in polar, amino acid residues to increase the surface accessibility of the core furin-cleavage site located between them.

In general, the furin-cleavage motif region from position P5 to P1 tends to comprise amino acid residues with a positive charge and/or high isoelectric points. In particular, the P1 position, which marks the position of furin proteolysis, is generally occupied by an arginine but other positively charged, amino acid residues may occur in this position. Positions P2 and P3 tend to be occupied by flexible, amino acid residues, and in particular P2 tends to be occupied by arginine, lysine, or sometimes by very small and flexible amino acid residues like glycine. The P4 position tends to be occupied by positively charged, amino acid residues in furin substrates. However, if the P4 position is occupied by an aliphatic, amino acid residue, then the lack of a positively charged, functional group can be compensated for by a positively charged residue located at position(s) P5 and/or P6. Positions P1' and P2' are commonly occupied by aliphatic and/or hydrophobic amino acid residues, with the P1' position most commonly being occupied by a serine.

The two, hydrophilic, flanking regions tend to be occupied by amino acid residues which are polar, hydrophilic, and have smaller amino acid functional groups; however, in certain verified furin substrates, the flanking regions do not contain any hydrophilic, amino acid residues (see Tian S, *Biochem* Insights 2: 9-20 (2009)).

The twenty amino acid residue, furin-cleavage motif and furin-cleavage site found in native, Shiga toxin A Subunits at the junction between the Shiga toxin A1 fragment and A2 fragment is well characterized in certain Shiga toxins. For example in StxA (SEQ ID NO:2) and SLT-1A (SEQ ID NO:1), this furin-cleavage motif is natively positioned from L238 to F257, and in SLT-2A (SEQ ID NO:3), this furin-cleavage motif is natively positioned from V237 to Q256. Based on amino acid homology, experiment, and/or furin-cleavage assays described herein, the skilled worker can identify furin-cleavage motifs in other native, Shiga toxin A Subunits or Shiga toxin effector polypeptides, where the motifs are actual furin-cleavage motifs or are predicted to result in the production of A1 and A2 fragments after furin cleavage of those molecules within a eukaryotic cell.

In certain embodiments, the Shiga toxin effector polypeptide of the present invention comprises (1) a Shiga toxin A1 fragment derived polypeptide having a carboxy-terminus and (2) a disrupted furin-cleavage motif at the carboxy-terminus of the Shiga toxin A1 fragment derived polypeptide. The carboxy-terminus of a Shiga toxin A1 fragment derived polypeptide may be identified by the skilled worker by using techniques known in the art, such as, e.g., by using protein sequence alignment software to identify (i) a furin-cleavage motif conserved with a naturally occurring Shiga toxin, (ii) a surface exposed, extended loop conserved with a naturally occurring Shiga toxin, and/or (iii) a stretch of amino acid residues which are predominantly hydrophobic (i.e. a hydrophobic "patch") that may be recognized by the ERAD system.

A protease-cleavage resistant, Shiga toxin effector polypeptide of the present invention (1) may be completely lacking any furin-cleavage motif at a carboxy-terminus of its Shiga toxin A1 fragment region and/or (2) comprise a disrupted furin-cleavage motif at the carboxy-terminus of its Shiga toxin A1 fragment region and/or region derived from the carboxy-terminus of a Shiga toxin A1 fragment. A disruption of a furin-cleavage motif include various alterations to an amino acid residue in the furin-cleavage motif, such as, e.g., a post-translation modification(s), an alteration of one or more atoms in an amino acid functional group, the addition of one or more atoms to an amino acid functional group, the association to a non-proteinaceous moiety(ies), and/or the linkage to an amino acid residue, peptide, polypeptide such as resulting in a branched proteinaceous structure.

Protease-cleavage resistant, Shiga toxin effector polypeptides may be created from a Shiga toxin effector polypeptide and/or Shiga toxin A Subunit polypeptide, whether naturally occurring or not, using a method described herein, described in 30 WO 2015/191764, and/or known to the skilled worker, wherein the resulting molecule still retains one or more Shiga toxin A Subunit functions.

For purposes of the present invention with regard to a furin-cleavage site or furin-cleavage motif, the term "disruption" or "disrupted" refers to an alteration from the naturally occurring furin-cleavage site and/or furin-cleavage motif, such as, e.g., a mutation, that results in a reduction in furin-cleavage proximal to the carboxy-terminus of a Shiga toxin A1 fragment region, or identifiable region derived thereof, as compared to the furin-cleavage of a wild-type Shiga toxin A Subunit or a polypeptide derived from a wild-type Shiga toxin A Subunit comprising only wild-type polypeptide sequences. An alteration to an amino acid residue in the furin-cleavage motif includes a mutation in the furin-cleavage motif, such as, e.g., a deletion, insertion, inversion, substitution, and/or carboxy-terminal truncation of the furin-cleavage motif, as well as a post-translation modification, such as, e.g., as a result of glycosylation, albumination, and the like which involve conjugating or linking a molecule to the functional group of an amino acid residue. Because the furin-cleavage motif is comprised of about twenty, amino acid residues, in theory, alterations, modifications, mutations, deletions, insertions, and/or truncations involving one or more amino acid residues of any one of these twenty positions might result in a reduction of furin-cleavage sensitivity (Tian S et al., *Sci Rep* 2: 261 (2012)). The disruption of a furin-cleavage site and/or furin-cleavage motif may or may not increase resistance to cleavage by other proteases, such as, e.g., trypsin and extracellular proteases common in the vascular system of mammals. The effects of a given disruption to cleavage sensitivity of a given protease may be tested by the skilled worker using techniques known in the art.

For purposes of the present invention, a "disrupted furin-cleavage motif" is furin-cleavage motif comprising an alteration to one or more amino acid residues derived from the 20 amino acid residue region representing a conserved, furin-cleavage motif found in native, Shiga toxin A Subunits at the junction between the Shiga toxin A1 fragment and A2 fragment regions and positioned such that furin cleavage of a Shiga toxin A Subunit results in the production of the A1 and A2 fragments; wherein the disrupted furin-cleavage motif exhibits reduced furin cleavage in an experimentally reproducible way as compared to a reference molecule comprising a wild-type, Shiga toxin A1 fragment region fused to a carboxy-terminal polypeptide of a size large enough to monitor furin cleavage using the appropriate assay known to the skilled worker and/or described herein.

Examples of types of mutations which can disrupt a furin-cleavage site and furin-cleavage motif are amino acid residue deletions, insertions, truncations, inversions, and/or substitutions, including substitutions with non-standard amino acids and/or non-natural amino acids. In addition, furin-cleavage sites and furin-cleavage motifs can be disrupted by mutations comprising the modification of an amino acid by the addition of a covalently-linked structure which masks at least one amino acid in the site or motif, such as, e.g., as a result of PEGylation, the coupling of small molecule adjuvants, and/or site-specific albumination.

If a furin-cleavage motif has been disrupted by mutation and/or the presence of non-natural amino acid residues, certain disrupted furin-cleavage motifs may not be easily recognizable as being related to any furin-cleavage motif, however, the carboxy-terminus of the Shiga toxin A1 fragment derived region will be recognizable and will define where the furin-cleavage motif would be located were it not disrupted. For example, a disrupted furin-cleavage motif may comprise less than the twenty, amino acid residues of the furin-cleavage motif due to a carboxy-terminal truncation as compared to a Shiga toxin A Subunit and/or Shiga toxin A1 fragment.

In certain embodiments, the Shiga toxin effector polypeptide of the present invention comprises (1) a Shiga toxin A1 fragment derived polypeptide having a carboxy-terminus and (2) a disrupted furin-cleavage motif at the carboxy-terminus of the Shiga toxin A1 fragment polypeptide region; wherein the Shiga toxin effector polypeptide (and any cell-targeting molecule comprising it) is more furin-cleavage resistant as compared to a reference molecule, such as, e.g., a wild-type Shiga toxin polypeptide comprising the carboxy-terminus of an A1 fragment and/or the conserved, furin-cleavage motif between A1 and A2 fragments. For example, a reduction in furin cleavage of one molecule compared to a reference molecule may be determined using an in vitro, furin-cleavage assay described in the Examples below, conducted using the same conditions, and then performing a quantitation of the band density of any fragments resulting from cleavage to quantitatively measure in change in furin cleavage.

In certain embodiments, the Shiga toxin effector polypeptide is more resistant to furin-cleavage in vitro and/or in vivo as compared to a wild-type, Shiga toxin A Subunit.

In general, the protease-cleavage sensitivity of a cell-targeting molecule of the present invention is tested by comparing it to the same molecule having its furin-cleavage resistant, Shiga toxin effector polypeptide replaced with a wild-type, Shiga toxin effector polypeptide comprising a Shiga toxin A1 fragment. In certain embodiments, the molecules of the present invention comprising a disrupted furin-cleavage motif exhibits a reduction in in vitro furin cleavage of 30%, 40%, 50%, 60%, 70%, 80%, 90%, 95%, 97%, 98% or greater compared to a reference molecule comprising a wild-type, Shiga toxin A1 fragment fused at its carboxy-terminus to a peptide or polypeptide, such as, e.g., the reference molecule SLT-1A-WT::scFv-1 described in Example 2, below.

Several furin-cleavage motif disruptions have been described. For example, mutating the two conserved arginines to alanines in the minimal R-x-x-R motif completely blocked processing by furin and/or furin-like proteases (see e.g Duda A et al., *J Virology* 78: 13865-70 (2004)). Because the furin-cleavage site motif is comprised of about twenty amino acid residues, in theory, certain mutations involving one or more of any one of these twenty, amino acid residue positions might abolish furin cleavage or reduce furin cleavage efficiency (see e.g. Tian S et al., *Sci Rep* 2: 261 (2012)).

In certain embodiments, the molecules of the present invention comprise a Shiga toxin effector polypeptide derived from at least one A Subunit of a member of the Shiga toxin family wherein the Shiga toxin effector polypeptide comprises a disruption in one or more amino acids derived from the conserved, highly accessible, protease-cleavage sensitive loop of Shiga toxin A Subunits. For example, in StxA and SLT-1A, this highly accessible, protease-sensitive loop is natively positioned from amino acid residues 242 to 261, and in SLT-2A, this conserved loop is natively positioned from amino acid residues 241 to 260. Based on polypeptide sequence homology, the skilled worker can identify this conserved, highly accessible loop structure in other Shiga toxin A Subunits. Certain mutations to the amino acid residues in this loop can reduce the accessibility of certain amino acid residues within the loop to proteolytic cleavage and this might reduce furin-cleavage sensitivity.

In certain embodiments, a molecule of the present invention comprises a Shiga toxin effector polypeptide comprising a disrupted furin-cleavage motif comprising a mutation in the surface-exposed, protease sensitive loop conserved among Shiga toxin A Subunits. In certain further embodiments, a molecule of the present invention comprises a Shiga toxin effector polypeptide comprising a disrupted furin-cleavage motif comprising a mutation in this protease-sensitive loop of Shiga toxin A Subunits, the mutation which reduce the surface accessibility of certain amino acid residues within the loop such that furin-cleavage sensitivity is reduced.

In certain embodiments, the disrupted furin-cleavage motif of a Shiga toxin effector polypeptide of the present invention comprises a disruption in terms of existence, position, or functional group of one or both of the consensus amino acid residues P1 and P4, such as, e.g., the amino acid residues in positions 1 and 4 of the minimal furin-cleavage motif R/Y-x-x-R. For example, mutating one or both of the two arginine residues in the minimal, furin consensus site R-x-x-R to alanine will disrupt a furin-cleavage motif and prevent furin-cleavage at that site. Similarly, amino acid residue substitutions of one or both of the arginine residues in the minimal furin-cleavage motif R-x-x-R to any non-conservative amino acid residue known to the skilled worker will reduced the furin-cleavage sensitivity of the motif. In particular, amino acid residue substitutions of arginine to any non-basic amino acid residue which lacks a positive charge, such as, e.g., A, G, P, S, T, D, E, Q, N, C, I, L, M, V, F, W, and Y, will result in a disrupted furin-cleavage motif.

In certain embodiments, the disrupted furin-cleavage motif of a Shiga toxin effector polypeptide of the present invention comprises a disruption in the spacing between the consensus amino acid residues P4 and P1 in terms of the number of intervening amino acid residues being other than two, and, thus, changing either P4 and/or P1 into a different position and eliminating the P4 and/or P1 designations. For example, deletions within the furin-cleavage motif of the minimal furin-cleavage site or the core, furin-cleavage motif will reduce the furin-cleavage sensitivity of the furin-cleavage motif.

In certain embodiments, the disrupted furin-cleavage motif comprises one or more amino acid residue substitutions, as compared to a wild-type, Shiga toxin A Subunit. In certain further embodiments, the disrupted furin-cleavage motif comprises one or more amino acid residue substitutions within the minimal furin-cleavage site R/Y-x-x-R, such as, e.g., for StxA and SLT-1A derived Shiga toxin effector polypeptides, the natively positioned amino acid residue R248 substituted with any non-positively charged, amino acid residue and/or R251 substituted with any non-positively charged, amino acid residue; and for SLT-2A derived Shiga toxin effector polypeptides, the natively positioned amino acid residue Y247 substituted with any non-positively charged, amino acid residue and/or R250 substituted with any non-positively charged, amino acid residue.

In certain embodiments, the disrupted furin-cleavage motif comprises an un-disrupted, minimal furin-cleavage site R/Y-x-x-R but instead comprises a disrupted flanking region, such as, e.g., amino acid residue substitutions in one or more amino acid residues in the furin-cleavage motif flanking regions natively position at, e.g., 241-247 and/or 252-259. In certain further embodiments, the disrupted furin cleavage motif comprises a substitution of one or more of the amino acid residues located in the P1-P6 region of the furin-cleavage motif, mutating P1' to a bulky amino acid, such as, e.g., R, W, Y, F, and H; and mutating P2' to a polar and hydrophilic amino acid residue; and substituting one or more of the amino acid residues located in the P1'-P6' region of the furin-cleavage motif with one or more bulky and hydrophobic amino acid residues In certain embodiments, the disruption of the furin-cleavage motif comprises a deletion, insertion, inversion, and/or mutation of at least one amino acid residue within the furin-cleavage motif. In certain embodiments, a protease-cleavage resistant, Shiga toxin effector polypeptide of the present invention may comprise a disruption of the amino acid sequence natively positioned at 249-251 of the A Subunit of Shiga-like toxin 1 (SEQ ID NO:1) or Shiga toxin (SEQ ID NO:2), or at 247-250 of the A Subunit of Shiga-like toxin 2 (SEQ ID NO:3) or the equivalent position in a conserved Shiga toxin effector polypeptide and/or non-native Shiga toxin effector polypeptide sequence. In certain further embodiments, protease-cleavage resistant, Shiga toxin effector polypeptides comprise a disruption which comprises a deletion of at least one amino acid within the furin-cleavage motif. In certain further embodiments, protease-cleavage resistant, Shiga toxin effector polypeptides comprise a disruption which comprises an insertion of at least one amino acid within the protease-cleavage motif region. In certain further embodiments, the protease-cleavage resistant, Shiga toxin effector polypeptides comprise a disruption which comprises an inversion of amino acids, wherein at least one inverted amino acid is within the protease motif region. In certain further embodiments, the protease-cleavage resistant, Shiga toxin effector polypeptides comprise a disruption which comprises a mutation, such as an amino acid substitution to a non-standard amino acid or an amino acid with a chemically modified side chain. Examples of single amino acid substitutions are provided in the Examples below.

In certain embodiments of the molecules of the present invention, the disrupted furin-cleavage motif comprises the deletion of nine, ten, eleven, or more of the carboxy-terminal amino acid residues within the furin-cleavage motif. In these embodiments, the disrupted furin-cleavage motif will not comprise a furin-cleavage site or a minimal furin-cleavage motif. In other words, certain embodiments lack a furin-cleavage site at the carboxy-terminus of the A1 fragment region.

In certain embodiments, the disrupted furin-cleavage motif comprises both an amino acid residue deletion and an amino acid residue substitution as compared to a wild-type, Shiga toxin A Subunit. In certain further embodiments, the disrupted furin-cleavage motif comprises one or more amino acid residue deletions and substitutions within the minimal furin-cleavage site R/Y-x-x-R, such as, e.g., for StxA and SLT-1A derived Shiga toxin effector polypeptides, the natively positioned amino acid residue R248 substituted with any non-positively charged, amino acid residue and/or R251 substituted with any non-positively charged, amino acid residue; and for SLT-2A derived Shiga toxin effector polypeptides, the natively positioned amino acid residue Y247 substituted with any non-positively charged, amino acid residue and/or R250 substituted with any non-positively charged, amino acid residue.

In certain embodiments, the disrupted furin-cleavage motif comprises an amino acid residue deletion and an amino acid residue substitution as well as a carboxy-terminal truncation as compared to a wild-type, Shiga toxin A Subunit. In certain further embodiments, the disrupted furin-cleavage motif comprises one or more amino acid residue deletions and substitutions within the minimal furin-cleavage site R/Y-x-x-R, such as, e.g., for StxA and SLT-1A derived Shiga toxin effector polypeptides, the natively positioned amino acid residue R248 substituted with any non-positively charged, amino acid residue and/or R251 substituted with any non-positively charged, amino acid residue; and for SLT-2A derived Shiga toxin effector polypeptides, the natively positioned amino acid residue Y247 substituted with any non-positively charged, amino acid residue and/or R250 substituted with any non-positively charged, amino acid residue.

In certain further embodiments, the disrupted furin-cleavage motif comprises both an amino acid substitution within the minimal furin-cleavage site R/Y-x-x-R and a carboxy-terminal truncation as compared to a wild-type, Shiga toxin A Subunit, such as, e.g., for StxA and SLT-1A derived Shiga toxin effector polypeptides, truncations ending at the natively amino acid position 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, or greater and comprising the natively positioned amino acid residue R248 and/or R251 substituted with any non-positively charged, amino acid residue where appropriate; and for SLT-2A derived Shiga toxin effector polypeptides, truncations ending at the natively amino acid position 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, or greater and comprising the natively positioned amino acid residue Y247 and/or R250 substituted with any non-positively charged, amino acid residue where appropriate.

In certain embodiments, the disrupted furin-cleavage motif comprises an insertion of one or more amino acid residues as compared to a wild-type, Shiga toxin A Subunit as long as the inserted amino residue(s) does not create a de novo furin-cleavage site. In certain embodiments, the insertion of one or more amino acid residues disrupts the natural spacing between the arginine residues in the minimal, furin-cleavage site R/Y-x-x-R, such as, e.g., StxA and SLT-1A derived polypeptides comprising an insertion of one or more amino acid residues at 249 or 250 and thus between R248 and R251; or SLT-2A derived polypeptides comprising an insertion of one or more amino acid residues at 248 or 249 and thus between Y247 and R250.

In certain embodiments, the disrupted furin-cleavage motif comprises both an amino acid residue insertion and a carboxy-terminal truncation as compared to a wild-type, Shiga toxin A Subunit. In certain embodiments, the disrupted furin-cleavage motif comprises both an amino acid residue insertion and an amino acid residue substitution as compared to a wild-type, Shiga toxin A Subunit. In certain embodiments, the disrupted furin-cleavage motif comprises both an amino acid residue insertion and an amino acid residue deletion as compared to a wild-type, Shiga toxin A Subunit.

In certain embodiments, the disrupted furin-cleavage motif comprises an amino acid residue deletion, an amino acid residue insertion, and an amino acid residue substitution as compared to a wild-type, Shiga toxin A Subunit.

In certain embodiments, the disrupted furin-cleavage motif comprises an amino acid residue deletion, insertion, substitution, and carboxy-terminal truncation as compared to a wild-type, Shiga toxin A Subunit.

In certain embodiments, the Shiga toxin effector polypeptide comprising a disrupted furin-cleavage motif is directly fused by a peptide bond to a molecular moiety comprising an amino acid, peptide, and/or polypeptide wherein the fused structure involves a single, continuous polypeptide. In these fusion embodiments, the amino acid sequence following the disrupted furin-cleavage motif should not create a de novo, furin-cleavage site at the fusion junction.

Any of the above protease-cleavage resistant, Shiga toxin effector polypeptide sub-regions and/or disrupted furin-cleavage motifs may be used alone or in combination with each individual embodiment of the present invention, including methods of the present invention.

C. T-Cell Hyper-Immunized, Shiga Toxin A Subunit Effector Polypeptides

In certain embodiments, the Shiga toxin effector polypeptide of the present invention comprises an embedded or inserted epitope-peptide. In certain further embodiments, the epitope-peptide is a heterologous, T-cell epitope-peptide, such as, e.g., an epitope considered heterologous to Shiga toxin A Subunits. In certain further embodiments, the epitope-peptide is a CD8+ T-cell epitope. In certain further embodiments, the CD8+ T-cell epitope-peptide has a binding affinity to a MHC class I molecule characterized by a dissociation constant ($K_D$) of $10^{-4}$ molar or less and/or the resulting MHC class I-epitope-peptide complex has a binding affinity to a T-cell receptor (TCR) characterized by a dissociation constant ($K_D$) of $10^{-4}$ molar or less.

In certain embodiments, the Shiga toxin effector polypeptide of the present invention comprises an embedded or inserted, heterologous, T-cell epitope, such as, e.g., a human CD8+ T-cell epitope. In certain further embodiments, the heterologous, T-cell epitope is embedded or inserted so as to disrupt an endogenous epitope or epitope region (e.g. a B-cell epitope and/or CD4+ T-cell epitope) identifiable in a naturally occurring Shiga toxin polypeptide or parental Shiga toxin effector polypeptide from which the Shiga toxin effector polypeptide of the present invention is derived.

For certain embodiments of the present invention, the Shiga toxin effector polypeptide (and any cell-targeting molecule comprising it) is CD8+ T-cell hyper-immunized, such as, e.g., as compared to a wild-type Shiga toxin polypeptide. The CD8+ T-cell hyper-immunized, Shiga toxin effector polypeptides of the present invention each comprise an embedded or inserted T-cell epitope-peptide. Hyper-immunized, Shiga toxin effector polypeptides can be created from Shiga toxin effector polypeptides and/or Shiga toxin A Subunit polypeptides, whether naturally occurring or not, using a method described herein, described in WO 2015/113007, and/or known to the skilled worker, wherein the resulting molecule still retains one or more Shiga toxin A Subunit functions.

For purposes of the claimed invention, a T-cell epitope is a molecular structure which is comprised by an antigenic peptide and can be represented by a linear, amino acid sequence. Commonly, T-cell epitopes are peptides of sizes of eight to eleven amino acid residues (Townsend A, Bodmer H, *Annu Rev Immunol* 7: 601-24 (1989)); however, certain T-cell epitope-peptides have lengths that are smaller than eight or larger than eleven amino acids long (see e.g. Livingstone A, Fathman C, *Annu Rev Immunol* 5: 477-501 (1987); Green K et al., *Eur Jmmunol* 34: 2510-9 (2004)). In certain embodiments, the embedded or inserted epitope is at least seven amino acid residues in length. In certain embodiments, the embedded or inserted epitope is bound by a TCR with a binding affinity characterized by a $K_D$ less than 10 mM (e.g. 1-100 μM) as calculated using the formula in Stone J et al., *Immunology* 126: 165-76 (2009). However, it should be noted that the binding affinity within a given range between the MHC-epitope and TCR may not correlate with antigenicity and/or immunogenicity (see e.g. Al-Ramadi B et al., *J Immunol* 155: 662-73 (1995)), such as due to factors like MHC-peptide-TCR complex stability, MHC-peptide density and MHC-independent functions of TCR cofactors such as CD8 (Baker B et al., *Immunity* 13: 475-84 (2000); Hornell T et al., *J Immunol* 170: 4506-14 (2003); Woolridge L et al., *J Immunol* 171: 6650-60 (2003)).

A heterologous, T-cell epitope is an epitope not already present in a wild-type Shiga toxin A Subunit; a naturally occurring Shiga toxin A Subunit; and/or a parental, Shiga toxin effector polypeptide used as a source polypeptide for modification by a method described herein, described in WO 2015/113007, and/or known to the skilled worker.

A heterologous, T-cell epitope-peptide may be incorporated into a source polypeptide via numerous methods known to the skilled worker, including, e.g., the processes of creating one or more amino acid substitutions within the source polypeptide, fusing one or more amino acids to the source polypeptide, inserting one or more amino acids into the source polypeptide, linking a peptide to the source polypeptide, and/or a combination of the aforementioned processes. The result of such a method is the creation of a modified variant of the source polypeptide which comprises one or more embedded or inserted, heterologous, T-cell epitope-peptides.

T-cell epitopes may be chosen or derived from a number of source molecules for use in the present invention. T-cell epitopes may be created or derived from various naturally occurring proteins. T-cell epitopes may be created or derived from various naturally occurring proteins foreign to mammals, such as, e.g., proteins of microorganisms. T-cell epitopes may be created or derived from mutated human proteins and/or human proteins aberrantly expressed by malignant human cells. T-cell epitopes may be synthetically created or derived from synthetic molecules (see e.g., Carbone F et al., *J Exp Med* 167: 1767-9 (1988); Del Val M et al., *J Virol* 65: 3641-6 (1991); Appella E et al., *Biomed Pept Proteins Nucleic Acids* 1: 177-84 (1995); Perez S et al., *Cancer* 116: 2071-80 (2010)).

Although any T-cell epitope-peptide is contemplated as being used as a heterologous, T-cell epitope of the present invention, certain epitopes may be selected based on desirable properties. One objective of the present invention is to create CD8+ T-cell hyper-immunized, Shiga toxin effector polypeptides for administration to vertebrates, meaning that the heterologous, T-cell epitope is highly immunogenic and can elicit robust immune responses in vivo when displayed complexed with a NMC class I molecule on the surface of a cell. In certain embodiments, the Shiga toxin effector polypeptide of the present invention comprises one or more, embedded or inserted, heterologous, T-cell epitopes which are CD8+ T-cell epitopes. A Shiga toxin effector polypeptide of the present invention that comprises a heterologous, CD8+ T-cell epitope is considered a CD8+ T-cell hyper-immunized, Shiga toxin effector polypeptide.

T-cell epitope components of the present invention may be chosen or derived from a number of source molecules already known to be capable of eliciting a vertebrate immune response. T-cell epitopes may be derived from various naturally occurring proteins foreign to vertebrates, such as, e.g., proteins of pathogenic microorganisms and non-self, cancer antigens. In particular, infectious microorganisms may contain numerous proteins with known antigenic and/or immunogenic properties. Further, infectious microorganisms may contain numerous proteins with known antigenic and/or immunogenic sub-regions or epitopes.

For example, the proteins of intracellular pathogens with mammalian hosts are sources for T-cell epitopes. There are numerous intracellular pathogens, such as viruses, bacteria, fungi, and single-cell eukaryotes, with well-studied antigenic proteins or peptides. T-cell epitopes can be selected or identified from human viruses or other intracellular pathogens, such as, e.g., bacteria like *mycobacterium*, fungi like toxoplasmae, and protists like trypanosomes.

For example, there are many immunogenic, viral peptide components of viral proteins from viruses that are infectious to humans. Numerous, human T-cell epitopes have been mapped to peptides within proteins from influenza A viruses, such as peptides in the proteins HA glycoproteins FE17, S139/1, CH65, C05, hemagglutin 1 (HA1), hemagglutinin 2 (HA2), nonstructural protein 1 and 2 (NS1 and NS 2), matrix protein 1 and 2 (M1 and M2), nucleoprotein (NP), neuraminidase (NA)), and many of these peptides have been shown to elicit human immune responses, such as by using ex vivo assay. Similarly, numerous, human T-cell epitopes have been mapped to peptide components of proteins from human cytomegaloviruses (HCMV), such as peptides in the proteins pp65 (UL83), UL128-131, immediate-early 1 (IE-1; UL123), glycoprotein B, tegument proteins, and many of these peptides have been shown to elicit human immune responses, such as by using ex vivo assays.

Another example is there are many immunogenic, cancer antigens in humans. The CD8+ T-cell epitopes of cancer and/or tumor cell antigens can be identified by the skilled worker using techniques known in the art, such as, e.g., differential genomics, differential proteomics, immunoproteomics, prediction then validation, and genetic approaches like reverse-genetic transfection (see e.g., Admon A et al., *Mol Cell Proteomics* 2: 388-98 (2003); Purcell A, Gorman J, *Mol Cell Proteomics* 3: 193-208 (2004); Comber J, Philip R, *Ther Adv Vaccines* 2: 77-89 (2014)). There are many antigenic and/or immunogenic T-cell epitopes already identified or predicted to occur in human cancer and/or tumor cells. For example, T-cell epitopes have been predicted in human proteins commonly mutated or overexpressed in neoplastic cells, such as, e.g., ALK, CEA, N-acetylglucosaminyl-transferase V (GnT-V), HCA587, HER-2/neu, MAGE, Melan-A/MART-1, MUC-1, p53, and TRAG-3 (see e.g., van der Bruggen P et al., *Science* 254: 1643-7 (1991); Kawakami Y et al., *J Exp Med* 180: 347-52 (1994); Fisk B et al., *J Exp Med* 181: 2109-17 (1995); Guilloux Y et al., *J Exp Med* 183: 1173 (1996); Skipper J et al., *J Exp Med* 183: 527 (1996); Brossart P et al., 93: 4309-17 (1999); Kawashima I et al., *Cancer Res* 59: 431-5 (1999); Papadopoulos K et al., *Clin Cancer Res* 5: 2089-93 (1999); Zhu B et al., *Clin Cancer Res* 9: 1850-7 (2003); Li B et al., *Clin Exp Immunol* 140: 310-9 (2005); Ait-Tahar K et al., *Int J Cancer* 118: 688-95 (2006); Akiyama Y et al., *Cancer Immunol Immunother* 61: 2311-9 (2012)). In addition, synthetic variants of T-cell epitopes from human cancer cells have been created (see e.g., Lazoura E, Apostolopoulos V, *Curr Med Chem* 12: 629-39 (2005); Douat-Casassus C et al., *J Med Chem* 50: 1598-609 (2007)).

While any T-cell epitope may be used in the polypeptides and molecules of the present invention, certain T-cell epitopes may be preferred based on their known and/or empirically determined characteristics. For example, in many species, the MHC alleles in its genome encode multiple MHC-I molecular variants. Because MHC class I protein polymorphisms can affect antigen-MHC class I complex recognition by CD8+ T-cells, T-cell epitopes may be chosen for use in the present invention based on knowledge about certain MHC class I polymorphisms and/or the ability of certain antigen-MHC class I complexes to be recognized by T-cells having different genotypes.

There are well-defined peptide-epitopes that are known to be immunogenic, MHC class I restricted, and/or matched with a specific human leukocyte antigen (HLA) variant(s). For applications in humans or involving human target cells, HLA-class I-restricted epitopes can be selected or identified by the skilled worker using standard techniques known in the art. The ability of peptides to bind to human MHC class I molecules can be used to predict the immunogenic potential of putative T-cell epitopes. The ability of peptides to bind to human MHC class I molecules can be scored using software tools. T-cell epitopes may be chosen for use as a heterologous, T-cell epitope component of the present invention based on the peptide selectivity of the HLA variants encoded by the alleles more prevalent in certain human populations. For example, the human population is polymorphic for the alpha chain of MHC class I molecules due to the varied alleles of the HLA genes from individual to individual. In certain T-cell epitopes may be more efficiently presented by a specific HLA molecule, such as, e.g., the commonly occurring HLA variants encoded by the HLA-A allele groups HLA-A2 and HLA-A3.

When choosing T-cell epitopes for use as a heterologous, T-cell epitope component of the present invention, multiple factors may be considered that can influence epitope generation and transport to receptive MHC class I molecules, such as, e.g., the presence and epitope specificity of the following factors in the target cell: proteasome, ERAAP/ERAP1, tapasin, and TAPs.

When choosing T-cell epitopes for use as a heterologous, T-cell epitope component of the present invention, epitope may be selected which best match the MHC class I molecules present in the cell-type or cell populations to be targeted. Different MHC class I molecules exhibit preferential binding to particular peptide sequences, and particular peptide-MHC class I variant complexes are specifically recognized by the t-cell receptors (TCRs) of effector T-cells. The skilled worker can use knowledge about MHC class I molecule specificities and TCR specificities to optimize the selection of heterologous, T-cell epitopes used in the present invention.

In addition, multiple, immunogenic, T-cell epitopes for MHC class I presentation may be embedded in the same Shiga toxin effector polypeptide of the present invention, such as, e.g., for use in the targeted delivery of a plurality of T-cell epitopes simultaneously. An example of a cell-targeting molecule of the present invention comprising multiple, CD8+ T-cell epitopes is SEQ ID NO:26.

Any of the protease-cleavage resistant, Shiga toxin effector polypeptide sub-regions and/or disrupted furin-cleavage motifs described herein may be used alone or in combination with each individual embodiment of the present invention, including methods of the present invention.

II. The General Structures of the Cell-Targeting Molecules of the Invention

The Shiga toxin effector polypeptides of the present invention provide robust and powerful scaffolds for engineering novel, cell-targeting molecules. The associated of cell-targeting binding regions with Shiga toxin effector polypeptides of the present invention enables the engineering of therapeutic and diagnostic molecules with desirable characteristics, such as, e.g., de-immunization, potent cytotoxicity, efficient intracellular routing, T-cell hyper-immunization, molecular stability, and in vivo tolerability at high dosages.

The present invention provides various cell-targeting molecules, each comprising (1) a cell-targeting, binding region and (2) a Shiga toxin effector polypeptide of the present invention. The Shiga toxin effector polypeptides of the present invention may be associated with and/or coupled to various, diverse, cell-targeting components (e.g. a molecular moiety and/or agent) to create cell-targeting molecules of the present invention. A cell-targeting molecule of the present invention comprises (1) a binding region capable of specifically binding an extracellular part of a target biomolecule and (2) a Shiga toxin effector polypeptide region comprising a Shiga toxin effector polypeptide of the present invention.

The Shiga toxin effector polypeptides of the present invention may be linked to one or more cell-targeting, binding regions that mediate cell-targeting via binding specificity to extracellular parts of target biomolecules, such as, e.g., a target biomolecule physically coupled to a cellular surface of a cell. One non-limiting example of a cell-targeting molecule of the present invention is a Shiga toxin effector polypeptide of the present invention fused to a proteinaceous, cell-targeting, binding region, such as, e.g., an immunoglobulin-type binding region.

A. Binding Regions

In certain embodiments, a binding region of a cell-targeting molecule of the present invention is a cell-targeting component, such as, e.g., a domain, molecular moiety, or agent, capable of binding specifically to an extracellular part of a target biomolecule (e.g. an extracellular target biomolecule) with high affinity. There are numerous types of binding regions known to skilled worker or which may be discovered by the skilled worker using techniques known in the art. For example, any cell-targeting component that exhibits the requisite binding characteristics described herein may be used as the binding region in certain embodiments of the cell-targeting molecules of the present invention.

An extracellular part of a target biomolecule refers to a portion of its structure exposed to the extracellular environment when the molecule is physically coupled to a cell, such as, e.g., when the target biomolecule is expressed at a cellular surface by the cell. In this context, exposed to the extracellular environment means that part of the target biomolecule is accessible by, e.g., an antibody or at least a binding moiety smaller than an antibody such as a single-domain antibody domain, a nanobody, a heavy-chain antibody domain derived from camelids or cartilaginous fishes, a single-chain variable fragment, or any number of engineered alternative scaffolds to immunoglobulins (see below). The exposure to the extracellular environment of or accessibility to a part of target biomolecule physically coupled to a cell may be empirically determined by the skilled worker using methods well known in the art.

A binding region of a cell-targeting molecule of the present invention may be, e.g., a ligand, peptide, immunoglobulin-type binding region, monoclonal antibody, engineered antibody derivative, or engineered alternative to antibodies.

In certain embodiments, the binding region of a cell-targeting molecule of the present invention is a proteinaceous moiety capable of binding specifically to an extracellular part of target biomolecule with high affinity. A binding region of a cell-targeting molecule of the present invention may comprise one or more various peptidic or polypeptide moieties, such as randomly generated peptide sequences, naturally occurring ligands or derivatives thereof, immunoglobulin derived domains, synthetically engineered scaffolds as alternatives to immunoglobulin domains, and the like (see e.g., WO 2005/092917; WO 2007/033497; Cheung M et al., *Mol Cancer* 9: 28 (2010); US 2013/0196928; WO 2014/164693; WO 2015/113005; WO 2015/113007; WO 2015/138452; WO 2015/191764). In certain embodiments, a cell-targeting molecule of the present invention comprises a binding region comprising one or more polypeptides capable of selectively and specifically binding an extracellular target biomolecule.

There are numerous binding regions known in the art that are useful for targeting molecules to specific cell-types via their binding characteristics, such as certain ligands, monoclonal antibodies, engineered antibody derivatives, and engineered alternatives to antibodies.

According to one specific but non-limiting aspect, the binding region of a cell-targeting molecule of the present invention comprises a naturally occurring ligand or derivative thereof that retains binding functionality to an extracellular target biomolecule, commonly a cell surface receptor. For example, various cytokines, growth factors, and hormones known in the art may be used to target the cell-targeting molecule of the present invention to the cell-surface of specific cell types expressing a cognate cytokine receptor, growth factor receptor, or hormone receptor. Certain non-limiting examples of ligands include (alternative names are indicated in parentheses) agiogenin, B-cell activating factors (BAFFs, APRIL), colony stimulating factors (CSFs), epidermal growth factors (EGFs), fibroblast growth factors (FGFs), vascular endothelial growth factors (VEGFs), insulin-like growth factors (IGFs), interferons, interleukins (such as IL-2, IL-6, and IL-23), nerve growth factors (NGFs), platelet derived growth factors, transforming growth factors (TGFs), and tumor necrosis factors (TNFs).

According to certain other embodiments of the cell-targeting molecules of the present invention, the binding region comprises a synthetic ligand capable of binding an extracellular target biomolecule (see e.g. Liang S et al., *J*

*Mol Med* 84: 764-73 (2006); Ahmed S et al., *Anal Chem* 82: 7533-41 (2010); Kaur K et al., *Methods Mol Biol* 1248: 239-47 (2015)).

In certain embodiments, the binding region comprises a peptidomimetic, such as, e.g., an AApeptide, gamma-AA-peptide, and/or sulfono-7-AApeptide (see e.g., Pilsl L, Reiser O, *Amino Acids* 41: 709-18 (2011); Akram O et al., *Mol Cancer Res* 12: 967-78 (2014); Wu H et al., *Chemistry* 21: 2501-7 (2015); Teng P et al., *Chemistry* 2016 Mar. 4)).

According to one specific, but non-limiting aspect, the binding region may comprise an immunoglobulin-type binding region. The term "immunoglobulin-type binding region" as used herein refers to a polypeptide region capable of binding one or more target biomolecules, such as an antigen or epitope. Binding regions may be functionally defined by their ability to bind to target molecules. Immunoglobulin-type binding regions are commonly derived from antibody or antibody-like structures; however, alternative scaffolds from other sources are contemplated within the scope of the term.

Immunoglobulin (Ig) proteins have a structural domain known as an Ig domain. Ig domains range in length from about 70-110 amino acid residues and possess a characteristic Ig-fold, in which typically 7 to 9 antiparallel beta strands arrange into two beta sheets which form a sandwich-like structure. The Ig fold is stabilized by hydrophobic amino acid interactions on inner surfaces of the sandwich and highly conserved disulfide bonds between cysteine residues in the strands. Ig domains may be variable (IgV or V-set), constant (IgC or C-set) or intermediate (IgI or I-set). Some Ig domains may be associated with a complementarity determining region (CDR), also called a "complementary determining region," which is important for the specificity of antibodies binding to their epitopes. Ig-like domains are also found in non-immunoglobulin proteins and are classified on that basis as members of the Ig superfamily of proteins. The HUGO Gene Nomenclature Committee (HGNC) provides a list of members of the Ig-like domain containing family.

An immunoglobulin-type binding region may be a polypeptide sequence of an antibody or antigen-binding fragment thereof wherein the amino acid sequence has been varied from that of a native antibody or an Ig-like domain of a non-immunoglobulin protein, for example by molecular engineering or selection by library screening. Because of the relevance of recombinant DNA techniques and in vitro library screening in the generation of immunoglobulin-type binding regions, antibodies can be redesigned to obtain desired characteristics, such as smaller size, cell entry, or other improvements for in vivo and/or therapeutic applications. The possible variations are many and may range from the changing of just one amino acid to the complete redesign of, for example, a variable region. Typically, changes in the variable region will be made in order to improve the antigen-binding characteristics, improve variable region stability, or reduce the potential for immunogenic responses.

There are numerous immunoglobulin-type binding regions contemplated as components of the present invention. In certain embodiments, the immunoglobulin-type binding region is derived from an immunoglobulin binding region, such as an antibody paratope capable of binding an extracellular target biomolecule. In certain other embodiments, the immunoglobulin-type binding region comprises an engineered polypeptide not derived from any immunoglobulin domain but which functions like an immunoglobulin binding region by providing high-affinity binding to an extracellular target biomolecule. This engineered polypeptide may optionally include polypeptide scaffolds comprising or consisting essentially of complementary determining regions from immunoglobulins as described herein.

There are also numerous binding regions in the prior art that are useful for targeting polypeptides to specific cell-types via their high-affinity binding characteristics. In certain embodiments, the binding region of the cell-targeting molecule of the present invention is selected from the group which includes autonomous $V_H$ domains, single-domain antibody domains (sdAbs), heavy-chain antibody domains derived from camelids ($V_HH$ fragments or $V_H$ domain fragments), heavy-chain antibody domains derived from camelid $V_HH$ fragments or $V_H$ domain fragments, heavy-chain antibody domains derived from cartilaginous fishes, immunoglobulin new antigen receptors (IgNARs), $V_{NAR}$ fragments, single-chain variable (scFv) fragments, nanobodies, Fd fragments consisting of the heavy chain and $C_H1$ domains, single chain Fv-$C_H3$ minibodies, dimeric $C_H2$ domain fragments ($C_H2D$), Fc antigen binding domains (Fcabs), isolated complementary determining region 3 (CDR3) fragments, constrained framework region 3, CDR3, framework region 4 (FR3-CDR3-FR4) polypeptides, small modular immunopharmaceutical (SMIP) domains, scFv-Fc fusions, multimerizing scFv fragments (diabodies, triabodies, tetrabodies), disulfide stabilized antibody variable (Fv) fragments, disulfide stabilized antigen-binding (Fab) fragments consisting of the $V_L$, $V_H$, $C_L$ and $C_H1$ domains, bivalent nanobodies, bivalent minibodies, bivalent $F(ab')_2$ fragments (Fab dimers), bispecific tandem $V_HH$ fragments, bispecific tandem scFv fragments, bispecific nanobodies, bispecific minibodies, and any genetically manipulated counterparts of the foregoing that retain its paratope and binding function (see Ward E et al., *Nature* 341: 544-6 (1989); Davies J, Riechmann L, *Biotechnology* (*NY*) 13: 475-9 (1995); Reiter Y et al., *Mol Biol* 290: 685-98 (1999); Riechmann L, Muyldermans S, *J Immunol Methods* 231: 25-38 (1999); Tanha J et al., *J Immunol Methods* 263: 97-109 (2002); Vranken W et al., *Biochemistry* 41: 8570-9 (2002); Jespers L et al., *J Mol Biol* 337: 893-903 (2004); Jespers L et al., *Nat Biotechnol* 22: 1161-5 (2004); To R et al., *J Biol Chem* 280: 41395-403 (2005); Saerens D et al., *Curr Opin Pharmacol* 8: 600-8 (2008); Dimitrov D, *MAbs* 1: 26-8 (2009); Weiner L, *Cell* 148: 1081-4 (2012); Ahmad Z et al., *Clin Dev Immunol* 2012: 980250 (2012)).

There are a variety of binding regions comprising polypeptides derived from the constant regions of immunoglobulins, such as, e.g., engineered dimeric Fc domains, monomeric Fcs (mFcs), scFv-Fcs, $V_HH$-Fcs, $C_H2$ domains, monomeric $C_H3$s domains ($mC_H3$s), synthetically reprogrammed immunoglobulin domains, and/or hybrid fusions of immunoglobulin domains with ligands (Hofer T et al., *Proc Natl Acad Sci U.S.A.* 105: 12451-6 (2008); Xiao J et al., *J Am Chem Soc* 131: 13616-13618 (2009); Xiao X et al., *Biochem Biophys Res Commun* 387: 387-92 (2009); Wozniak-Knopp G et al., *Protein Eng Des Sel* 23 289-97 (2010); Gong R et al., *PLoS ONE* 7: e42288 (2012); Wozniak-Knopp G et al., *PLoS ONE* 7: e30083 (2012); Ying T et al., *J Biol Chem* 287: 19399-408 (2012); Ying T et al., *J Biol Chem* 288: 25154-64 (2013); Chiang M et al., *JAm Chem Soc* 136: 3370-3 (2014); *Rader C, Trends Biotechnol* 32: 186-97 (2014); Ying T et al., *Biochimica Biophys Acta* 1844: 1977-82 (2014)).

In accordance with certain other embodiments, the binding region comprises an engineered, alternative scaffold to immunoglobulin domains. Engineered alternative scaffolds are known in the art which exhibit similar functional characteristics to immunoglobulin-derived structures, such as high-affinity and specific binding of target biomolecules, and may provide improved characteristics to certain immunoglobulin domains, such as, e.g., greater stability or reduced immunogenicity. Generally, alternative scaffolds to immunoglobulins are less than 20 kilodaltons, consist of a single polypeptide chain, lack cysteine residues, and exhibit relatively high thermodynamic stability.

For certain embodiments of the cell-targeting molecules of the present invention, the binding region comprises an alternative scaffold selected from the group which includes autonomous $V_H$ domains, single-domain antibody domains (sdAbs), heavy-chain antibody domains derived from camelids ($V_HH$ fragments or $V_H$ domain fragments), heavy-chain antibody domains derived from camelid $V_HH$ fragments or $V_H$ domain fragments, heavy-chain antibody domains derived from cartilaginous fishes, immunoglobulin new antigen receptors (IgNARs), $V_{NAR}$ fragments, single-chain variable (scFv) fragments, nanobodies, Fd fragments consisting of the heavy chain and $C_H1$ domains, permutated Fvs (pFv), single chain Fv-$C_H3$ minibodies, dimeric $C_H2$ domain fragments ($C_H2D$), Fe antigen binding domains (Fcabs), isolated complementary determining region 3 (CDR3) fragments, constrained framework region 3, CDR3, framework region 4 (FR3-CDR3-FR4) polypeptides, small modular immunopharmaceutical (SMIP) domains, scFv-Fc fusions, multimerizing scFv fragments (diabodies, triabodies, tetrabodies), disulfide stabilized antibody variable (Fv) fragments, disulfide stabilized antigen-binding (Fab) fragments consisting of the $V_L$, $V_H$, $C_L$ and $C_H1$ domains, bivalent nanobodies, bivalent minibodies, bivalent $F(ab')_2$ fragments (Fab dimers), bispecific tandem $V_HH$ fragments, bispecific tandem scFv fragments, bispecific nanobodies, bispecific minibodies, and any genetically manipulated counterparts of the foregoing that retains its binding functionality (Wörn A, Plückthun A, *J Mol Biol* 305: 989-1010 (2001); Xu L et al., *Chem Biol* 9: 933-42 (2002); Wikman M et al., *Protein Eng Des Sel* 17: 455-62 (2004); Binz H et al., *Nat Biotechnol* 23: 1257-68 (2005); Hey T et al., *Trends Biotechnol* 23:514-522 (2005); Holliger P, Hudson P, *Nat Biotechnol* 23: 1126-36 (2005); Gill D, Damle N, *Curr Opin Biotech* 17: 653-8 (2006); Koide A, Koide S, *Methods Mol Biol* 352: 95-109 (2007); Byla P et al., *J Biol Chem* 285: 12096 (2010); Zoller F et al., *Molecules* 16: 2467-85 (2011); Alfarano P et al., *Protein Sci* 21: 1298-314 (2012); Madhurantakam C et al., *Protein Sci* 21: 1015-28 (2012); Varadamsetty G et al., *J Mol Biol* 424: 68-87 (2012); Reichen C et al., *J Struct Biol* 185: 147-62 (2014)).

For example, numerous alternative scaffolds have been identified which bind to the extracellular receptor HER2 (see e.g. Wikman M et al., *Protein Eng Des Sel* 17: 455-62 (2004); Orlova A et al. *Cancer Res* 66: 4339-8 (2006); Ahlgren S et al., *Bioconjug Chem* 19: 235-43 (2008); Feldwisch J et al., *J Mol Biol* 398: 232-47 (2010); U.S. Pat. Nos. 5,578,482; 5,856,110; 5,869,445; 5,985,553; 6,333,169; 6,987,088; 7,019,017; 7,282,365; 7,306,801; 7,435,797; 7,446,185; 7,449,480; 7,560,111; 7,674,460; 7,815,906; 7,879,325; 7,884,194; 7,993,650; 8,241,630; 8,349,585; 8,389,227; 8,501,909; 8,512,967; 8,652,474; and U.S. patent application 2011/0059090). In addition to alternative antibody formats, antibody-like binding abilities may be conferred by non-proteinaceous compounds, such as, e.g., oligomers, RNA molecules, DNA molecules, carbohydrates, and glycocalyxcalixarenes (see e.g. Sansone F, Casnati A, *Chem Soc Rev* 42: 4623-39 (2013)) or partially proteinaceous compounds, such as, e.g., phenol-formaldehyde cyclic oligomers coupled with peptides and calixarene-peptide compositions (see e.g. U.S. Pat. No. 5,770,380).

Any of the above binding region structures may be used as a component of a molecule of the present invention as long as the binding region component has a dissociation constant of $10^{-5}$ to $10^{-12}$ moles per liter, preferably less than 200 nanomolar (nM), towards an extracellular target biomolecule.

In certain embodiments, the cell-targeting molecules of the present invention comprise a Shiga toxin effector polypeptide of the present invention linked and/or fused to a binding region capable of specifically binding an extracellular part of a target biomolecule or an extracellular target biomolecule. Extracellular target biomolecules may be selected based on numerous criteria, such as a criterion described herein.

B. Extracellular Target Biomolecules Bound by the Binding Regions

In certain embodiments, the binding region of a cell-targeting molecules of the present invention comprises a proteinaceous region capable of binding specifically to an extracellular part of a target biomolecule or an extracellular target biomolecule, preferably which is physically coupled to the surface of a cell type of interest, such as, e.g., a cancer cell, tumor cell, plasma cell, infected cell, or host cell harboring an intracellular pathogen. Target biomolecules bound by the binding region of a cell-targeting molecule of the present invention may include biomarkers over-proportionately or exclusively present on cancer cells, immune cells, and/or cells infected with intracellular pathogens, such as, e.g., viruses, bacteria, fungi, prions, or protozoans.

The term “target biomolecule” refers to a biological molecule, commonly a proteinaceous molecule or a protein modified by post-translational modifications, such as glycosylation, that is bound by a binding region of a cell-targeting molecule of the present invention resulting in the targeting of the cell-targeting molecule to a specific cell, cell-type, and/or location within a multicellular organism.

For purposes of the present invention, the term “extracellular” with regard to a target biomolecule refers to a biomolecule that has at least a portion of its structure exposed to the extracellular environment. The exposure to the extracellular environment of or accessibility to a part of target biomolecule coupled to a cell may be empirically determined by the skilled worker using methods well known in the art. Non-limiting examples of extracellular target biomolecules include cell membrane components, transmembrane spanning proteins, cell membrane-anchored biomolecules, cell-surface-bound biomolecules, and secreted biomolecules.

With regard to the present invention, the phrase “physically coupled” when used to describe a target biomolecule means covalent and/or non-covalent intermolecular interactions couple the target biomolecule, or a portion thereof, to the outside of a cell, such as a plurality of non-covalent interactions between the target biomolecule and the cell where the energy of each single interaction is on the order of at least about 1-5 kiloCalories (e.g., electrostatic bonds, hydrogen bonds, ionic bonds, Van der Walls interactions, hydrophobic forces, etc.). All integral membrane proteins can be found physically coupled to a cell membrane, as well as peripheral membrane proteins. For example, an extracellular target biomolecule might comprise a transmembrane spanning region, a lipid anchor, a glycolipid anchor, and/or be non-covalently associated (e.g. via non-specific hydrophobic interactions and/or lipid binding interactions) with a factor comprising any one of the foregoing.

Extracellular parts of target biomolecules may include various epitopes, including unmodified polypeptides, polypeptides modified by the addition of biochemical functional groups, and glycolipids (see e.g. U.S. Pat. No. 5,091,178; EP2431743).

The binding regions of the cell-targeting molecules of the present invention may be designed or selected based on numerous criteria, such as the cell-type specific expression of their target biomolecules, the physical localization of their target biomolecules with regard to specific cell types, and/or the properties of their target biomolecules. For example, certain cell-targeting molecules of the present invention comprise binding regions capable of binding cell-surface target biomolecules that are expressed at a cellular surface exclusively by only one cell-type of a species or only one cell-type within a multicellular organism. It is desirable, but not necessary, that an extracellular target biomolecule be intrinsically internalized or be readily forced to internalize upon interacting with a cell-targeting molecule of the present invention.

Among certain embodiments of the cell-targeting molecules of the present invention, the binding region is derived from an immunoglobulin-type polypeptide selected for specific and high-affinity binding to a surface antigen on the cell surface of a cancer or tumor cell, where the antigen is restricted in expression to cancer or tumor cells (see Glokler J et al., *Molecules* 15: 2478-90 (2010); Liu Y et al., *Lab Chip* 9: 1033-6 (2009). In accordance with other embodiments, the binding region is selected for specific and high-affinity binding to a surface antigen on the cell surface of a cancer cell, where the antigen is over-expressed or preferentially expressed by cancer cells as compared to non-cancer cells. Some representative target biomolecules include, but are not limited to, the following enumerated targets associated with cancers and/or specific immune cell types.

Many immunoglobulin-type binding regions that bind with high affinity to extracellular epitopes associated with cancer cells are known to the skilled worker, such as binding regions that bind any one of the following target biomolecules: annexin A1, B3 melanoma antigen, B4 melanoma antigen, CD2, CD3, CD4, CD19, CD20 (B-lymphocyte antigen protein CD20), CD22, CD25 (interleukin-2 receptor TL2R), CD30 (TNFRSF8), CD37, CD38 (cyclic ADP ribose hydrolase), CD40, CD44 (hyaluronan receptor), ITGAV (CD51), CD56, CD66, CD70, CD71 (transferrin receptor), CD73, CD74 (HLA-DR antigens-associated invariant chain), CD79, CD98, endoglin (END, CD105), CD106 (VCAM-1), CD138, chemokine receptor type 4 (CDCR-4, fusin, CD184), CD200, insulin-like growth factor 1 receptor (CD221), mucin1 (MUC1, CD227, CA6, CanAg), basal cell adhesion molecule (B-CAM, CD239), CD248 (endosialin, TEM1), tumor necrosis factor receptor 10b (TNFRSF10B, CD262), tumor necrosis factor receptor 13B (TNFRSF13B, TACI, CD276), vascular endothelial growth factor receptor 2 (KDR, CD309), epithelial cell adhesion molecule (EpCAM, CD326), human epidermal growth factor receptor 2 (HER2, Neu, ErbB2, CD340), cancer antigen 15-3 (CA5-3), cancer antigen 19-9 (CA 19-9), cancer antigen 125 (CA125, MUC16), CA242, carcinoembryonic antigen-related cell adhesion molecules (e.g. CEACAM3 (CD66d) and CEACAM5), carcinoembryonic antigen protein (CEA), choline transporter-like protein 4 (SLC44A4), chondroitin sulfate proteoglycan 4 (CSP4, MCSP, NG2), CTLA4, delta-like proteins (e.g. DLL3, DLL4), ectonucleotide pyrophosphatase/phosphodiesterase proteins (e.g. ENPP3), endothelin receptors (ETBRs), epidermal growth factor receptor (EGFR, ErbB1), folate receptors (FOLRs, e.g. FRα), G-28, ganglioside GD2, ganglioside GD3, HLA-Dr10, HLA-DRB, human epidermal growth factor receptor 1 (HER1), HER3/ErbB-3, Ephrin type-B receptor 2 (EphB2), epithelial cell adhesion molecule (EpCAM), fibroblast activation protein (FAP/seprase), guanylyl cyclase c (GCC), insulin-like growth factor 1 receptor (IGF1R), interleukin 2 receptor (IL-2R), interleukin 6 receptor (IL-6R), integrins alpha-V beta-3 ($\alpha_v\beta3$), integrins alpha-V beta-5 (αvβ5), integrins alpha-5 beta-1 ($\alpha_5\beta_1$), L6, zinc transporter (LIV-1), MPG, melanoma-associated antigen 1 protein (MAGE-1), melanoma-associated antigen 3 (MAGE-3), mesothelin (MSLN), metalloreductase STEAP1, MPG, MS4A, NaPi2b, nectins (e.g. nectin-4), p21, p97, polio virus receptor-like 4 (PVRL4), protease-activated-receptors (such as PAR1), prostate-specific membrane antigen proteins (PSMAs), SLIT and NTRK-like proteins (e.g. SLITRK6), Thomas-Friedenreich antigen, transmembrane glycoprotein (GPNMB), trophoblast glycoproteins (TPGB, 5T4, WAIF1), and tumor-associated calcium signal transducers (TACSTDs, e.g. Trop-2, EGP-1, etc.) (see e.g. Lui B et al., *Cancer Res* 64: 704-10 (2004); Novellino L et al., *Cancer Immunol Immunother* 54: 187-207 (2005); Bagley R et al., *Int J Oncol* 34: 619-27 (2009); Gerber H et al., *mAbs* 1: 247-53 (2009); Beck A et al., *Nat Rev Immunol* 10: 345-52 (2010); Andersen J et al., *J Biol Chem* 287: 22927-37 (2012); Nolan-Stevaux O et al., *PLoS One* 7: e50920 (2012); Rust S et al., *Mol Cancer* 12: 11 (2013)). This list of target biomolecules is intended to be non-limiting. It will be appreciated by the skilled worker that any desired target biomolecule associated with a cancer cell or other desired cell type may be used to design or select a binding region which may be suitable for use as a component of a cell-targeting molecule of the present invention.

Examples of other target biomolecules which are strongly associated with cancer cells and are bound with high-affinity by a known immunoglobulin-type binding region include BAGE proteins (B melanoma antigens), basal cell adhesion molecules (BCAMs or Lutheran blood group glycoproteins), bladder tumor antigen (BTA), cancer-testis antigen NY-ESO-1, cancer-testis antigen LAGE proteins, CD19 (B-lymphocyte antigen protein CD19), CD21 (complement receptor-2 or complement 3d receptor), CD26 (dipeptidyl peptidase-4, DPP4, or adenosine deaminase complexing protein 2), CD33 (sialic acid-binding immunoglobulin-type lectin-3), CD52 (CAMPATH-1 antigen), CD56, CS1 (SLAM family number 7 or SLAMF7), cell surface A33 antigen protein (gpA33), Epstein-Barr virus antigen proteins, GAGE/PAGE proteins (melanoma associated cancer/testis antigens), hepatocyte growth factor receptor (HGFR or c-Met), MAGE proteins, melanoma antigen recognized by T-cells 1 protein (MART-1/MelanA, MARTI), mucins, Preferentially Expressed Antigen of Melanoma (PRAME) proteins, prostate specific antigen protein (PSA), prostate stem cell antigen protein (PSCA), Receptor for Advanced Glycation Endroducts (RAGE), tumor-associated glycoprotein 72 (TAG-72), vascular endothelial growth factor receptors (VEGFRs), and Wilms' tumor antigen.

Examples of other target biomolecules which are strongly associated with cancer cells are carbonic anhydrase IX (CA9/CAIX), claudin proteins (CLDN3, CLDN4), ephrin type-A receptor 3 (EphA3), folate binding proteins (FBP), ganglioside GM2, insulin-like growth factor receptors, integrins (such as CD11a-c), receptor activator of nuclear factor kappa B (RANK), receptor tyrosine-protein kinase erB-3, tumor necrosis factor receptor 10A (TRAIL-R1/DR4), tumor necrosis factor receptor 10B (TRAIL-R2), tenascin C, and CD64 (FcγRI) (see Hough C et al., *Cancer Res* 60: 6281-7 (2000); Thepen T et al., *Nat Biotechnol* 18: 48-51 (2000); Pastan I et al., *Nat Rev Cancer* 6: 559-65 (2006);

Pastan, *Annu Rev Med* 58: 221-37 (2007); Fitzgerald D et al., *Cancer Res* 71: 6300-9 (2011); Scott A et al., *Cancer Immun* 12: 14-22 (2012)). This list of target biomolecules is intended to be non-limiting.

In addition, there are numerous other examples of contemplated, target biomolecules, such as, e.g., ADAM metalloproteinases (e.g. ADAM-9, ADAM-10, ADAM-12, ADAM-15, ADAM-17), ADP-ribosyltransferases (ART1, ART4), antigen F4/80, bone marrow stroma antigens (BST1, BST2), break point cluster region-c-abl oncogene (BCR-ABL) proteins, C3aR (complement component 3a receptors), CD7, CD13, CD14, CD15 (Lewis X or stage-specific embryonic antigen 1), CD23 (FC epsilon RII), CD45 (protein tyrosine phosphatase receptor type C), CD49d, CD53, CD54 (intercellular adhesion molecule 1), CD63 (tetraspanin), CD69, CD80, CD86, CD88 (complement component 5a receptor 1), CD115 (colony stimulating factor 1 receptor), IL-1R (interleukin-1 receptor), CD123 (interleukin-3 receptor), CD129 (interleukin 9 receptor), CD183 (chemokine receptor CXCR3), CD191 (CCR1), CD193 (CCR3), CD195 (chemokine receptor CCR5), CD203c, CD225 (interferon-induced transmembrane protein 1), CD244 (Natural Killer Cell Receptor 2B4), CD282 (Toll-like receptor 2), CD284 (Toll-like receptor 4), CD294 (GPR44), CD305 (leukocyte-associated immunoglobulin-like receptor 1), ephrin type-A receptor 2 (EphA2), FceRIa, galectin-9, alpha-fetoprotein antigen 17-A1 protein, human aspartyl (asparaginyl) beta-hydroxylase (HAAH), immunoglobulin-like transcript ILT-3, lysophosphatidlglycerol acyltransferase 1 (LPGAT1/IAA0205), lysosome-associated membrane proteins (LAMPs, such as CD107), melanocyte protein PMEL (gp100), myeloid-related protein-14 (mrp-14), NKG2D ligands (e.g., MICA, MICB, ULBP1, ULBP2, UL-16-binding proteins, H-60s, Rae-1s, and homologs thereof), receptor tyrosine-protein kinase erbB-3, SART proteins, scavenger receptors (such as CD64 and CD68), Siglecs (sialic acid-binding immunoglobulin-type lectins), syndecans (such as SDC1 or CD138), tyrosinase, tyrosinease-related protein 1 (TRP-1), tyrosinease-related protein 2 (TRP-2), tyrosinase associated antigen (TAA), APO-3, BCMA, CD2, CD3, CD4, CD8, CD18, CD27, CD28, CD29, CD41, CD49, CD90, CD95 (Fas), CD103, CD104, CD134 (OX40), CD137 (4-1B), CD152 (CTLA-4), chemokine receptors, complement proteins, cytokine receptors, histocompatibility proteins, ICOS, interferon-alpha, interferon-beta, c-myc, osteoprotegerin, PD-1, RANK, TACI, TNF receptor superfamily member (TNF-R1, TNFR-2), Apo2/TRAIL-R1, TRAIL-R2, TRAIL-R3, and TRAIL-R4 (see Scott A et al., *Cancer Immunity* 12: 14 (2012); Cheever M et al., *Clin Cancer Res* 15: 5323-37 (2009)), for target biomolecules and note the target biomolecules described therein are non-limiting examples).

In certain embodiments, the binding region comprises or consists essentially of an immunoglobulin-type binding region capable of specifically binding with high-affinity to the cellular surface of a cell type of the immune system. For example, immunoglobulin-type binding domains are known which bind to immune cell surface factors, such as, e.g., CD1, CD2, CD3, CD4, CD5, CD6, CD7, CD8, CD9, CD10, CD11, CD12, CD13, CD14, CD15, CD16, CD17, CD18, CD19, CD20, CD21, CD22, CD23, CD24, CD25, CD26, CD27, CD28, CD29, CD30, CD31, CD33, CD34, CD35, CD36, CD37, CD38, CD40, CD41, CD56, CD61, CD62, CD66, CD95, CD117, CD123, CD235, CD146, CD326, interleukin-1 receptor (IL-1R), interleukin-2 receptor (IL-2R), receptor activator of nuclear factor kappa B (RANKL), SLAM-associated protein (SAP), and TNFSF18 (tumor necrosis factor ligand 18 or GITRL).

For further examples of target biomolecules and binding regions envisioned for use in the molecules of the present invention, see WO 2005/092917, WO 2007/033497, US2009/0156417, JP4339511, EP1727827, DE602004027168, EP1945660, JP4934761, EP2228383, US2013/0196928, WO 2014/164680, WO 2014/164693, WO 2015/138435, WO 2015/138452, WO 2015/113005, WO 2015/113007, WO 2015/191764, US20150259428, 62/168,758, 62/168,759, 62/168,760, 62/168,761, 62/168,762, 62/168,763, and PCT/US2016/016580.

It will be appreciated by the skilled worker that any desired target biomolecule may be used to design or select a suitable binding region to be associated and/or coupled with a Shiga toxin effector polypeptide to produce a cell-targeting molecule of the present invention.

Any of the above binding regions described herein may be used alone or in combination with each individual embodiment of the present invention, including methods of the present invention.

The general structure of the cell-targeting molecules of the present invention is modular, in that various, diverse, cell-targeting binding regions may be associated with various, Shiga toxin effector polypeptides of the present invention to create different, cell-targeting molecules of the present invention which exhibit differences in their cell-targeting activities due to differences in their binding regions. This enables a variety of cell-targeting activities to be exhibited by different embodiments of the cell-targeting molecules of the present invention such that different embodiments target different types of cells with Shiga toxin effector functions, such as, e.g., cytostasis, cytotoxicity, and intracellular delivery of exogenous materials. Furthermore, certain embodiments of the cell-targeting molecules of the present invention exhibit certain characteristics due to differences in their respective Shiga toxin effector polypeptide regions, such as, e.g., low antigenicity and/or immunogenicity when administered to a chordate, resistance to proteolytic cleavage by certain proteases, high stability when administered to a multicellular organism, in vivo tolerability at high dosages, ability to deliver a cargo to an intracellular location, and/or ability to deliver a T-cell epitope to a MHC class I molecule for presentation on a cellular surface.

For the purposes of the present invention, the specific order or orientation of the Shiga toxin effector polypeptide region and the cell-targeting, binding region is not fixed in relation to each other or within the cell-targeting molecule of the present invention unless expressly noted. For example, when the cell-targeting molecule of the present invention is a fusion protein with an amino-terminal(s) and carboxy-terminal(s), various arrangements of the components of the invention may be suitable (see e.g. FIG. 1). In certain embodiments of the cell-targeting molecules of the present invention, the arrangement of their components in relation to each other or within the cell-targeting molecule are limited as described herein. For example, certain endoplasmic reticulum retention/retrieval signal motifs are commonly positioned on a carboxy-terminus of a cell-targeting molecule of the present invention and/or a carboxy-terminus of a protein component of a cell-targeting molecule of the present invention.

C. Endoplasmic Reticulum Retention/Retrieval Signal Motif of a Member of the KDEL Family Certain embodiments of the cell-targeting molecules of the present invention comprise one or more carboxy-terminal, endoplasmic reticulum retention/retrieval signal motifs of a member of the KDEL Family. Any endoplasmic reticulum retention/retrieval signal motif described in WO 2015/138435 may be suitable for use as a component of certain cell-targeting molecules of the present invention.

For purposes of the present invention, the phrase "endoplasmic reticulum retention/retrieval signal motif," KDEL-type signal motif ("KDEL" disclosed as SEQ ID NO: 514), or signal motif refers to any member of the KDEL family capable of functioning within a eukaryotic cell to promote subcellular localization of a cell-targeting molecule of the present invention or component thereof to the endoplasmic reticulum via KDEL receptors.

The carboxy-terminal lysine-asparagine-glutamate-leucine (KDEL) sequence (SEQ ID NO:514) is a canonical, endoplasmic reticulum retention and retrieval signal motif for soluble proteins in eukaryotic cells and is recognized by the KDEL receptors (see, Capitani M, Sallese M, *FEBS Lett* 583: 3863-71 (2009), for review). The KDEL family of signal motifs includes many KDEL-like motifs, such as HDEL (SEQ ID NO:515), RDEL (SEQ ID NO:516), WDEL (SEQ ID NO:517), YDEL (SEQ ID NO:518), HEEL (SEQ ID NO:519), KEEL (SEQ ID NO:520), REEL (SEQ ID NO:521), KFEL (SEQ ID NO:522), KIEL (SEQ ID NO:523), DKEL (SEQ ID NO:524), KKEL (SEQ ID NO:525), HNEL (SEQ ID NO:526), HTEL (SEQ ID NO:527), KTEL (SEQ ID NO:528), and HVEL (SEQ ID NO:529), all of which are found at the carboxy-terminals of proteins which are known to be residents of the lumen of the endoplasmic reticulum of throughout multiple phylogenetic kingdoms (Munro S, Pelham H, Cell 48: 899-907 (1987); Raykhel I et al., *J Cell Biol* 179: 1193-204 (2007)). The KDEL signal motif family includes at least 46 polypeptide variants shown using synthetic constructs (Raykhel, *J Cell Biol* 179: 1193-204 (2007)). Additional KDEL signal motifs include ALEDEL (SEQ ID NO:530), HAEDEL (SEQ ID NO:531), HLEDEL (SEQ ID NO:532), KLEDEL (SEQ ID NO:533), IRSDEL (SEQ ID NO:534), ERSTEL (SEQ ID NO:535), and RPSTEL (SEQ ID NO:536) (Alanen H et al., *J Mol Biol* 409: 291-7 (2011)). A generalized consensus motif representing the majority of KDEL signal motifs has been described as [KRHQSA]-[DENQ]-E-L (Hulo N et al., *Nucleic Acids Res* 34: D227-30 (2006)).

Proteins containing KDEL family signal motifs are bound by KDEL receptors distributed throughout the Golgi complex and transported to the endoplasmic reticulum by a microtubule-dependent mechanism for release into the lumen of the endoplasmic reticulum (Griffiths G et al., *J Cell Biol* 127: 1557-74 (1994); Miesenbock G, Rothman J, *J Cell Biol* 129: 309-19 (1995)). KDEL receptors dynamically cycle between the Golgi complex and endoplasmic reticulum (Jackson M et al., *EMBO J.* 9: 3153-62 (1990); Schutze M et al., *EMBO J.* 13: 1696-1705(1994)).

For purposes of the present invention, the members of the KDEL family include synthetic signal motifs able to function within a eukaryotic cell to promote subcellular localization of a protein to the endoplasmic reticulum via KDEL receptors. In other words, some members of the KDEL family might not occur in nature or have yet to be observed in nature but have or may be constructed and empirically verified by the skilled worker using methods known in the art; see e.g., Raykhel I et al., *J Cell Biol* 179: 1193-204 (2007).

As a component of certain cell-targeting molecules of the present invention, the KDEL-type signal motif is physically located, oriented, or arranged within the cell-targeting molecule such that it is on a carboxy-terminal of a polypeptide component of the cell-targeting molecule of the present invention.

In certain embodiments of the cell-targeting molecules of the present invention, the binding region and the Shiga toxin effector polypeptide region, and/or endoplasmic reticulum retention/retrieval signal motif may be directly linked to each other and/or suitably linked to each other via one or more intervening components, such as with one or more linkers well known to the skilled worker and/or described herein.

D. Additional Exogenous Materials

In certain embodiments, the cell-targeting molecules of the present invention comprises an additional exogeouns material. An "additional exogenous material" as used herein refers to one or more atoms or molecules, often not generally present in both Shiga toxins and native target cells, where the cell-targeting molecule of the present invention can be used to specifically transport such material to the interior of a cell. In one sense, the entire cell-targeting molecule of the invention is an exogenous material which will enter the cell; thus, the "additional" exogenous materials are heterologous materials linked to but other than the core cell-targeting molecule itself. Non-limiting examples of additional exogenous materials are radionucleides, peptides, detection promoting agents, proteins, small molecule chemotherapeutic agents, and polynucleotides.

In certain embodiments of the cell-targeting molecules of the present invention, the additional exogenous material is one or more radionucleides, such as, e.g., $^{211}At$, $^{131}I$, $^{125}I$, $^{90}Y$, $^{111}In$, $^{186}Re$, $^{188}Re$, $^{153}Sm$, $^{212}Bi$, $^{32}P$, $^{60}C$, and/or radioactive isotopes of lutetium.

In certain embodiments, the additional exogenous material comprises a proapoptotic peptide, polypeptide, or protein, such as, e.g., BCL-2, caspases (e.g. fragments of caspase-3 or caspase-6), cytochromes, granzyme B, apoptosis-inducing factor (AIF), BAX, tBid (truncated Bid), and proapoptotic fragments or derivatives thereof (see e.g., Ellerby H et al., *Nat Med* 5: 1032-8 (1999); Mai J et al., *Cancer Res* 61: 7709-12 (2001); Jia L et al., *Cancer Res* 63: 3257-62 (2003); Liu Y et al., *Mol Cancer Ther* 2: 1341-50 (2003); Perea S et al., *Cancer Res* 64: 7127-9 (2004); Xu Y et al., *J Immunol* 173: 61-7 (2004); Dalken B et al., *Cell Death Differ* 13: 576-85 (2006); Wang T et al., *Cancer Res* 67: 11830-9 (2007); Kwon M et al., *Mol Cancer Ther* 7:1514-22 (2008); Qiu X et al., *Mol Cancer Ther* 7: 1890-9 (2008); Shan L et al., *Cancer Biol Ther* 11: 1717-22 (2008); Wang F et al., *Clin Cancer Res* 16: 2284-94 (2010); Kim J et al., *J Virol* 85: 1507-16 (2011)).

In certain embodiments, the additional exogenous material comprises a protein or polypeptide comprising an enzyme. In certain other embodiments, the additional exogenous material is a nucleic acid, such as, e.g. a ribonucleic acid that functions as a small inhibiting RNA (siRNA) or microRNA (miRNA). In certain embodiments, the additional exogenous material is an antigen, such as antigens derived from pathogens, bacterial proteins, viral proteins, proteins mutated in cancer, proteins aberrantly expressed in cancer, or T-cell complementary determining regions. For example, exogenous materials include antigens, such as those characteristic of antigen-presenting cells infected by bacteria, and T-cell complementary determining regions capable of functioning as exogenous antigens. Exogenous materials comprising polypeptides or proteins may optionally comprise one or more antigens whether known or unknown to the skilled worker.

In certain embodiments of the cell-targeting molecules of the present invention, all heterologous antigens and/or epitopes associated with the Shiga toxin effector polypeptide are arranged in the cell-targeting molecule amino-terminal to the carboxy-terminus of the Shiga toxin A1 fragment region of the Shiga toxin effector polypeptide. In certain further embodiments, all heterologous antigens and/or epitopes associated with the Shiga toxin effector polypeptide are associated, either directly or indirectly, with the Shiga toxin effector polypeptide at a position amino-terminal to the carboxy-terminus of the Shiga toxin A1 fragment region of the Shiga toxin effector polypeptide. In certain further embodiments, all additional exogenous material(s) which is an antigen is arranged amino-terminal to the Shiga toxin effector polypeptide, such as, e.g., fused directly or indirectly to the amino terminus of the Shiga toxin effector polypeptide.

In certain embodiments of the cell-targeting molecules of the present invention, the additional exogenous material is a cytotoxic agent, such as, e.g., a small molecule chemotherapeutic agent, anti-neoplastic agent, cytotoxic antibiotic, alkylating agent, antimetabolite, topoisomerase inhibitor, and/or tubulin inhibitor. Non-limiting examples of cytotoxic agents suitable for use with the present invention include aziridines, cisplatins, tetrazines, procarbazine, hexamethylmelamine, vinca alkaloids, taxanes, camptothecins, etoposide, doxorubicin, mitoxantrone, teniposide, novobiocin, aclarubicin, anthracyclines, actinomycin, amanitin, amatoxins, bleomycin, centanamycin (indolecarboxamide), plicamycin, mitomycin, daunorubicin, epirubicin, idarubicins, dolastatins, maytansines, maytansionoids, duromycin, docetaxel, duocarmycins, adriamycin, calicheamicin, auristatins, pyrrolobenzodiazepines, pyrrolobenzodiazepine dimers (PBDs), carboplatin, 5-fluorouracil (5-FU), capecitabine, mitomycin C, paclitaxel, 1,3-Bis(2-chloroethyl)-1-nitrosourea (BCNU), rifampicin, cisplatin, methotrexate, gemcitabine, aceglatone, acetogenins (e.g. bullatacin and bullatacinone), aclacinomysins, AG1478, AG1571, aldophosphamide glycoside, alkyl sulfonates (e.g., busulfan, improsulfan, and piposulfan), alkylating agents (e.g. thiotepa and cyclosphosphamide), aminolevulinic acid, aminopterin, amsacrine, ancitabine, anthramycin, arabinoside, azacitidine, azaserine, aziridines (e.g., benzodopa, carboquone, meturedopa, and uredopa), azauridine, bestrabucil, bisantrene, bisphosphonates (e.g. clodronate), bleomycins, bortezomib, bryostatin, cactinomycin, callystatin, carabicin, carminomycin, carmofur, carmustine, carzinophilin, CC-1065, chlorambucil, chloranbucil, chlornaphazine, chlorozotocin, chromomycinis, chromoprotein enediyne antibiotic chromophores, CPT-11, cryptophycins (e.g. cryptophycin 1 and cryptophycin 8), cyclophosphamide, cytarabine, dacarbazine, dactinomycin, daunomycin, defofamine, demecolcine, detorubicin, diaziquone, 6-diazo-5-oxo-L-norleucine, dideoxyuridine, difluoromethylornithine (DMFO), doxifluridine, doxorubicins (e.g., morpholinodoxorubicin, cyanomorpholino-doxorubicin, 2-pyrrolinodoxorubicin, and deoxydoxorubicin), dynemicins, edatraxate, edatrexate, eleutherobins, elformithine, elliptinium acetate, enediyne antibiotics (e.g. calicheamicins), eniluracil, enocitabine, epirubicins, epothilone, esorubicins, esperamicins, estramustine, ethylenimines, 2-ethylhydrazide, etoglucid, fludarabine, folic acid analogues (e.g., denopterin, methotrexate, pteropterin, and trimetrexate), folic acid replenishers (e.g. frolinic acid), fotemustine, fulvestrant, gacytosine, gallium nitrate, gefitinib, gemcitabine, hydroxyurea, ibandronate, ifosfamide, imatinib mesylate, erlotinib, fulvestrant, letrozole, PTK787/ZK 222584 (Novartis, Basel, CH), oxaliplatin, leucovorin, rapamycin, lapatinib, lonafarnib, sorafenib, methylamelamines (e.g., altretamine, triethy lenemelamine, triethy lenephosphoramide, triethylenethiophosphoramide and trimethylomelamine), pancratistatins, sarcodictyins, spongistatins, nitrogen mustards (e.g., chlorambucil, chlornaphazine, cyclophosphamide, mechlorethamine, mechlorethamine oxide hydrochloride, melphalan, novembichin, phenesterine, prednimustine, trofosfamide, and uracil mustard), nitrosureas (e.g., carmustine, fotemustine, lomustine, nimustine, and ranimnustine), dynemicins, neocarzinostatin chromophores, anthramycin, detorubicin, epirubicins, marcellomycins, mitomycins (e.g. mitomycin C), mycophenolic acid, nogalamycins, olivomycins, peplomycins, potfiromycins, puromycins, quelamycins, rodorubicins, ubenimex, zinostatins, zorubicins, purine analogs (e.g., fludarabine, 6-mercaptopurine, thiamiprine, and thioguanine), pyrimidine analogs (e.g., ancitabine, azacitidine, 6-azauridine, dideoxyuridine, doxifluridine, enocitabine, and floxuridine), aceglatone, lentinan, lonidainine, maytansinoids (e.g. maytansins and ansamitocins), mitoguazone, mitoxantrone, mopidanmol, nitraerine, pentostatin, phenamet, pirarubicin, podophyllinic acid, 2-ethylhydrazide, rhizoxin, sizofuran, spirogermanium, tenuazonic acid, triaziquone, 2,2',2"trichlorotriethylamine, trichothecenes (e.g., T-2 toxin, verracurin A, roridin A, and anguidine), urethan, vindesine, mannomustine, mitobronitol, mitolactol, pipobroman, arabinoside, cyclophosphamide, toxoids (e.g. paclitaxel and doxetaxel), 6-thioguanine, mercaptopurine, platinum, platinum analogs (e.g. cisplatin and carboplatin), etoposide (VP-16), mitoxantrone, vinorelbine, novantrone, daunomycin, xeloda, topoisomerase inhibitor RFS 2000, retinoids (e.g. retinoic acid), capecitabine, lomustine, losoxantrone, mercaptopurines, nimustine, nitraerine, rapamycin, razoxane, roridin A, spongistatins, streptonigrins, streptozocins, sutent, T-2 toxin, thiamiprine, thiotepa, toxoids (e.g. paclitaxel and doxetaxel), tubercidins, verracurin A, vinblastine, vincristine, and structural analogs of any of the aforementioned (e.g. synthetic analogs), and/or derivatives of any of the aforementioned (see e.g., Lindell T et al., *Science* 170: 447-9 (1970); Remillard S et al., *Science* 189: 1002-5 (1975); Ravry M et al., *Am J Clin Oncol* 8: 148-50 (1985); Ravry M et al., *Cancer Treat Rep* 69: 1457-8 (1985); Sternberg C et al., *Cancer* 64: 2448-58 (1989); Bai R et al., *Biochem Pharmacol* 39: 1941-9 (1990); Boger D, Johnson D, *Proc Natl Acad Sci USA* 92: 3642-9 (1995); Beck J et al., *Leuk Lymphoma* 41: 117-24 (2001); Cassady J et al., *Chem Pharm Bull* (Tokyo) 52: 1-26 (2004); Sapra P et al., *Clin Cancer Res* 11: 5257-64 (2005); Okeley N et al., *Clinc Cancer Res* 16: 888-97 (2010); Oroudjev E et al., *Mol Cancer Ther* 9: 2700-13 (2010); Ellestad G, *Chirality* 23: 660-71 (2011); Kantarjian H et al., *Lancet Oncol* 13: 403-11 (2012); Moldenhauer G et al., *J Natl Cancer Inst* 104: 622-34 (2012); Meulendijks D et al., *Invest New Drugs* 34: 119-28 (2016)).

E. Structure-Function Relationships of Cell-Targeting Molecules of the Invention For certain embodiments of the cell-targeting molecules of the present invention, there specific structure-function relationships that have been observed, such as, e.g., component relative orientation effects on cytotoxic potency; furin-cleavage sensitivity effects on in vivo tolerability at certain dosages; furin-cleavage sensitivity effects on in vitro stability; furin-cleavage sensitivity effects on in vivo half-life; and furin-cleavage sensitivity effects on in vivo, non-specific toxicity in multicellular organisms.

In certain embodiments of the cell-targeting molecules of the present invention, the specific order or orientation of the Shiga toxin effector polypeptide region and binding region is fixed such that the binding region is located within the cell-targeting molecules more proximal to the carboxy-terminus of the Shiga toxin effector polypeptide region than to the amino-terminus of the Shiga toxin effector polypeptide region. In certain embodiments of the cell-targeting molecules of the present invention, the arrangement of the Shiga toxin effector polypeptide region within the cell-targeting molecule is limited to being at and/or proximal to the amino-terminus of a polypeptide component of the cell-targeting molecule (see FIG. 1). For example, certain embodiments of the cell-targeting molecule of the present invention comprise 1) a binding region oriented within the cell-targeting molecule at a position carboxy-terminal to the Shiga toxin effector polypeptide region, 2) a binding region associated with the Shiga toxin effector polypeptide region at a position distal from the amino-terminus of the Shiga toxin effector polypeptide region (e.g. distances of 50, 100, 200, or 250 amino acid residues or greater), 3) a binding region not sterically covering the amino-terminus of the Shiga toxin effector polypeptide region, and/or 4) a binding region not sterically hindering a structure(s) near the amino-terminus of the Shiga toxin effector polypeptide region (see e.g. FIG. 1; WO 2015138452). In certain further embodiments, the cell-targeting molecules of the present invention are capable of exhibiting more optimal cytotoxic potency, such as, e.g., exhibiting a $CD_{50}$ value which is 3-fold, 4-fold, 5-fold, 6-fold, 7-fold, 8-fold, 9-fold, 10-fold, or higher than a related cell-targeting reference molecule comprising the same Shiga toxin A Subunit effector polypeptide region(s) and binding region(s), wherein the binding region is 1) amino-terminal to the Shiga toxin A Subunit effector polypeptide region, 2) associated with the Shiga toxin effector polypeptide region at a position proximal to the amino-terminus of the Shiga toxin effector polypeptide region (e.g. distances of less than 50, 40, 30, 20, or 10 amino acid residues or less), 3) not sterically covering the amino-terminus of the Shiga toxin effector polypeptide region, and/or 4) not sterically hindering a structure(s) near the amino-terminus of the Shiga toxin effector polypeptide region (see e.g. FIG. 1; WO 2015/138452).

In certain embodiments, the Shiga toxin A Subunit effector polypeptide of the present invention comprises a Shiga toxin A1 fragment derived region comprising a disrupted furin-cleavage motif at the carboxy-terminus of the Shiga toxin A1 fragment derived region (such as a disrupted furin-cleavage site located at the carboxy-terminus of a Shiga toxin A1 fragment region) (see e.g. FIG. 1; WO 2015/191764). In certain further embodiments, the Shiga toxin effector polypeptide is more furin-cleavage resistant as compared to a related reference molecule, such as, e.g., a molecule comprising a wild-type, Shiga toxin A Subunit or Shiga toxin A1 fragment (see e.g. WO 2015/191764). In certain further embodiments, the Shiga toxin effector polypeptide of the present invention exhibits a reduction in furin-cleavage reproducibly observed to be 30%, 40%, 50%, 60%, 70%, 80%, 90%, 95%, 97%, 98%, 99%, or less (including 100% for no cleavage) than the furin-cleavage of a reference molecule observed in the same assay under the same conditions. In certain further embodiments, the Shiga toxin effector polypeptide is more cleavage resistant to a protease other than furin as compared to a related reference molecule, such as, e.g., a molecule comprising a wild-type, Shiga toxin A Subunit or Shiga toxin A1 fragment.

Certain cell-targeting molecules of the present invention exhibit cytotoxic potencies within 100-fold, 20-fold, 10-fold, 5-fold, or less than a reference molecule comprising a wild-type Shiga toxin effector polypeptide region despite the lack of any compensatory structural feature for the disrupted furin-cleavage motif in the Shiga toxin effector polypeptide. For cell-targeting molecules comprising Shiga toxin A Subunit derived regions which do not maintain the furin cleavage event, i.e. molecules comprising Shiga toxin A Subunit derived components which are not cleaved by furin inside target cells, one alternative for preserving maximal cytotoxicity is compensation. Compensation for the lack of furin cleavage of a Shiga toxin A Subunit region in cytotoxic molecule might be accomplished by presenting the Shiga toxin A Subunit region in a "pre-processed" form. For example, a cell-targeting molecule comprising a Shiga toxin A Subunit region may be constructed such that the carboxy-terminus of the Shiga toxin A Subunit derived polypeptide is 1) proximal to a carboxy-terminus of the molecule and 2) matches or resembles a native Shiga toxin A1 fragment after cleavage by furin (see WO 2015/191764). Such compensation is not required in certain cell-targeting molecules of the present invention, rather it is intentionally avoided in order to provide one or more function(s), such as, e.g., improved in vivo tolerability at certain dosages; increased in vitro stability; increased in vivo half-life; and/or reduced in vivo, non-specific toxicity in multicellular organisms. For certain embodiments, these beneficial function(s) are present without any significant reduction in cytotoxic potency of the cell-targeting molecule of the present invention as compared to a reference molecule comprising a wild-type Shiga toxin effector polypeptide.

In certain embodiments, the cell-targeting molecule of the present invention comprises a Shiga toxin A Subunit effector polypeptide comprising a Shiga toxin A1 fragment derived region comprising a disrupted furin-cleavage motif at the carboxy-terminus of the Shiga toxin A1 fragment derived region (such as a disrupted furin-cleavage site located at the carboxy-terminus of a Shiga toxin A1 fragment region) (see e.g. FIG. 1; WO 2015/191764) but do not comprise any compensatory protease cleavage site proximal to the carboxy-terminus of the Shiga toxin A1 fragment derived region and/or oriented between the Shiga toxin effector polypeptide and a relatively large, molecule moiety (e.g. a binding region of a size greater than 4.5 kDa, 6, kDa, 9 kDa, 12 kDa, 15 kDa, 20 kDa, 25 kDa, 28 kDa, 30 kDa, 41 kDa, or 50 kDa). In certain further embodiments, the cell-targeting molecule of the present invention comprises a Shiga toxin effector polypeptide which is more furin-cleavage resistant as compared to a related reference molecule, such as, e.g., a molecule comprising a wild-type, Shiga toxin A Subunit or Shiga toxin A1 fragment (see e.g. WO 2015/191764). In certain further embodiments, the cell-targeting molecule of the present invention exhibits a reduction in furin-cleavage of 30%, 40%, 50%, 60%, 70%, 80%, 90%, 95%, 97%, 98%, 99%, or 100% less than the furin-cleavage of a reference molecule observed in the same assay under the same conditions while the cell-targeting molecule exhibits a cytotoxic potency within 100-fold, 20-fold, 10-fold, 5-fold, or less than a reference molecule comprising a wild-type Shiga toxin effector polypeptide region. In certain further embodiments, the cell-targeting molecule of the present invention exhibits an improvement in in vivo tolerability as compared to a related reference molecule comprising a Shiga toxin effector polypeptide having a wild-type furin cleavage motif and/or wild-type furin cleavage site at the carboxy-terminus of its Shiga toxin A1 fragment region (see e.g. WO 2015/191764). For example, an increase in in vivo tolerability may be determined by comparing measurements of mortality, signs of morbidity, and/or certain clinical signs in groups of laboratory animals administered different molecules at the same dosages (see e.g. Examples, infra; WO 2015/191764).

In certain embodiments, the cell-targeting molecule of the present invention comprises a Shiga toxin A Subunit effector polypeptide comprising a Shiga toxin A1 fragment derived region comprising a disrupted furin-cleavage motif at the carboxy-terminus of the Shiga toxin A1 fragment derived region (such as a disrupted furin-cleavage site located at the carboxy-terminus of a Shiga toxin A1 fragment derived region) (see e.g. FIG. 1; WO 2015/191764). For certain further embodiments, the cell-targeting molecule of the present invention that comprise a cytotoxic component, the cell-targeting molecule exhibits reduced non-specific toxicity as compared to more protease-cleavage sensitive variants, which have greater propensity to break apart and thereby release the cytotoxic component from the binding region, especially when administered to living materials, such as, e.g., a population of cells, a tissue, and/or an organism. Furthermore, certain protease-cleavage resistant, cell-targeting molecules of the present invention may exhibit increased, in vivo, half-lives after administration to living materials (e.g., certain chordates) as compared to more protease-cleavage sensitive variants based on the protease-cleavage resistance conferred to the cell-targeting molecule by the disrupted furin-cleavage motif at the carboxy-terminus of the Shiga toxin A1 fragment derived region.

III. Linkages Connecting Components of the Invention and/or Their Subcomponents

Individual cell-targeting binding regions, Shiga toxin effector polypeptides, and/or components of the cell-targeting molecules present invention may be suitably linked to each other via one or more linkers well known in the art and/or described herein. Individual polypeptide subcomponents of the binding regions, e.g. heavy chain variable regions ($V_H$), light chain variable regions ($V_L$), CDR, and/or ABR regions, may be suitably linked to each other via one or more linkers well known in the art and/or described herein. Proteinaceous components of the invention, e.g., multi-chain binding regions, may be suitably linked to each other or other polypeptide components of the invention via one or more linkers well known in the art. Peptide components of the invention, e.g., KDEL family endoplasmic reticulum retention/retrieval signal motifs, may be suitably linked to another component of the invention via one or more linkers, such as a proteinaceous linker, which are well known in the art.

Suitable linkers are generally those which allow each polypeptide component of the present invention to fold with a three-dimensional structure very similar to the polypeptide components produced individually without any linker or other component. Suitable linkers include single amino acids, peptides, polypeptides, and linkers lacking any of the aforementioned, such as various non-proteinaceous carbon chains, whether branched or cyclic.

Suitable linkers may be proteinaceous and comprise one or more amino acids, peptides, and/or polypeptides. Proteinaceous linkers are suitable for both recombinant fusion proteins and chemically linked conjugates. A proteinaceous linker typically has from about 2 to about 50 amino acid residues, such as, e.g., from about 5 to about 30 or from about 6 to about 25 amino acid residues. The length of the linker selected will depend upon a variety of factors, such as, e.g., the desired property or properties for which the linker is being selected. In certain embodiments, the linker is proteinaceous and is linked near the terminus of a protein component of the present invention, typically within about 20 amino acids of the terminus.

Suitable linkers may be non-proteinaceous, such as, e.g. chemical linkers. Various non-proteinaceous linkers known in the art may be used to link cell-targeting binding regions to the Shiga toxin effector polypeptide components of the cell-targeting molecules of the present invention, such as linkers commonly used to conjugate immunoglobulin polypeptides to heterologous polypeptides. For example, polypeptide regions may be linked using the functional side chains of their amino acid residues and carbohydrate moieties such as, e.g., a carboxy, amine, sulfhydryl, carboxylic acid, carbonyl, hydroxyl, and/or cyclic ring group. For example, disulfide bonds and thioether bonds may be used to link two or more polypeptides. In addition, non-natural amino acid residues may be used with other functional side chains, such as ketone groups. Examples of non-proteinaceous chemical linkers include but are not limited to N-succinimidyl (4-iodoacetyl)-aminobenzoate, S—(N-succinimidyl) thioacetate (SATA), N-succinimidyl-oxycarbonyl-cu-methyl-α-(2-pyridyldithio) toluene (SMPT), N-succinimidyl 4-(2-pyridyldithio)-pentanoate (SPP), succinimidyl 4-(N-maleimidomethyl) cyclohexane carboxylate (SMCC or MCC), sulfosuccinimidyl (4-iodoacetyl)-aminobenzoate, 4-succinimidyl-oxycarbonyl-α-(2-pyridyldithio) toluene, sulfosuccinimidyl-6-(α-methyl-α-(pyridyldithiol)-toluamido) hexanoate, N-succinimidyl-3-(-2-pyridyldithio)-proprionate (SPDP), succinimidyl 6(3(-(-2-pyridyldithio)-proprionamido) hexanoate, sulfosuccinimidyl 6(3(-(-2-pyridyldithio)-propionamido) hexanoate, maleimidocaproyl (MC), maleimidocaproyl-valine-citrulline-p-aminobenzyloxycarbonyl (MC-vc-PAB), 3-maleimidobenzoic acid N-hydroxysuccinimide ester (MBS), alpha-alkyl derivatives, sulfoNHS-ATMBA (sulfosuccinimidyl N-[3-(acetylthio)-3-methylbutyryl-beta-alanine]), sulfodichlorophenol, 2-iminothiolane, 3-(2-pyridyldithio)-propionyl hydrazide, Ellman's reagent, dichlorotriazinic acid, and S-(2-thiopyridyl)-L-cysteine.

Suitable linkers, whether proteinaceous or non-proteinaceous, may include, e.g., protease sensitive, environmental redox potential sensitive, pH sensitive, acid cleavable, photocleavable, and/or heat sensitive linkers.

Proteinaceous linkers may be chosen for incorporation into recombinant fusion cell-targeting molecules of the present invention. For recombinant fusion cell-targeting proteins of the invention, linkers typically comprise about 2 to 50 amino acid residues, preferably about 5 to 30 amino acid residues. Commonly, proteinaceous linkers comprise a majority of amino acid residues with polar, uncharged, and/or charged residues, such as, e.g., threonine, proline, glutamine, glycine, and alanine. Non-limiting examples of proteinaceous linkers include alanine-serine-glycine-glycine-proline-glutamate (ASGGPE) (SEQ ID NO:538), valine-methionine (VM), alanine-methionine (AM), AM($G_{2\ to\ 4}$S)xAM (SEQ ID NO: 539) where G is glycine, S is serine, and x is an integer from 1 to 10.

Proteinaceous linkers may be selected based upon the properties desired. Proteinaceous linkers may be chosen by the skilled worker with specific features in mind, such as to optimize one or more of the fusion molecule's folding, stability, expression, solubility, pharmacokinetic properties, pharmacodynamic properties, and/or the activity of the fused domains in the context of a fusion construct as compared to the activity of the same domain by itself. For example, proteinaceous linkers may be selected based on flexibility, rigidity, and/or cleavability. The skilled worker may use databases and linker design software tools when choosing linkers. In certain linkers may be chosen to optimize expression. In certain linkers may be chosen to promote intermolecular interactions between identical polypeptides or proteins to form homomultimers or different polypeptides or proteins to form heteromultimers. For example, proteinaceous linkers may be selected which allow for desired non-covalent interactions between polypeptide components of the cell-targeting molecules of the invention, such as, e.g., interactions related to the formation dimers and other higher order multimers.

Flexible proteinaceous linkers are often greater than 12 amino acid residues long and rich in small, non-polar amino acid residues, polar amino acid residues, and/or hydrophilic amino acid residues, such as, e.g., glycines, serines, and threonines. Flexible proteinaceous linkers may be chosen to increase the spatial separation between components and/or to allow for intramolecular interactions between components. For example, various "GS" linkers are known to the skilled worker and are composed of multiple glycines and/or one or more serines, sometimes in repeating units, such as, e.g., $(G\times S)_n$ (SEQ ID NO:540), $(S_xG)_n$ (SEQ ID NO:541), $(GGGGS)_n$ (SEQ ID NO:542), and $(G)_n$ (SEQ ID NO:543), in which x is 1 to 6 and n is 1 to 30. Non-limiting examples of flexible proteinaceous linkers include GKSSGSGSESKS (SEQ ID NO:544), EGKSSGSGSESKEF (SEQ ID NO:545), GSTSGSGKSSEGKG (SEQ ID NO:546), GSTSGSGKSSEGSGSTKG (SEQ ID NO:547), GSTSGSGKPGSGEGSTKG (SEQ ID NO:548), SRSSG (SEQ ID NO:549), and SGSSC (SEQ ID NO:550).

Rigid proteinaceous linkers are often stiff alpha-helical structures and rich in proline residues and/or one or more strategically placed prolines. Rigid linkers may be chosen to prevent intramolecular interactions between linked components.

Suitable linkers may be chosen to allow for in vivo separation of components, such as, e.g., due to cleavage and/or environment-specific instability. In vivo cleavable proteinaceous linkers are capable of unlinking by proteolytic processing and/or reducing environments often at a specific site within an organism or inside a certain cell type. In vivo cleavable proteinaceous linkers often comprise protease sensitive motifs and/or disulfide bonds formed by one or more cysteine pairs. In vivo cleavable proteinaceous linkers may be designed to be sensitive to proteases that exist only at certain locations in an organism, compartments within a cell, and/or become active only under certain physiological or pathological conditions (such as, e.g., involving proteases with abnormally high levels, proteases overexpressed at certain disease sites, and proteases specifically expressed by a pathogenic microorganism). For example, there are proteinaceous linkers known in the art which are cleaved by proteases present only intracellularly, proteases present only within specific cell types, and proteases present only under pathological conditions like cancer or inflammation, such as, e.g., R-x-x-R motif and AMGRSGGGCAGNRVGSSLSCGGLNLQAM (SEQ ID NO:551).

In certain embodiments of the cell-targeting molecules of the present invention, a linker may be used which comprises one or more protease sensitive sites to provide for cleavage by a protease present within a target cell. In certain embodiments of the cell-targeting molecules of the invention, a linker may be used which is not cleavable to reduce unwanted toxicity after administration to a vertebrate organism.

Suitable linkers may include, e.g., protease sensitive, environmental redox potential sensitive, pH sensitive, acid cleavable, photocleavable, and/or heat sensitive linkers, whether proteinaceous or non-proteinaceous (see e.g., Doronina S et al., *Bioconjug Chem* 17: 114-24 (2003); Saito G et al., *Adv Drug Deliv Rev* 55: 199-215 (2003); Jeffrey S et al., *J Med Chem* 48: 1344-58 (2005); Sanderson R et al., *Clin Cancer Res* 11: 843-52 (2005); Erickson H et al., *Cancer Res* 66: 4426-33 (2006); Chen X et al., *Adv Drug Deliv Rev* 65: 1357-69 (2013)). Suitable cleavable linkers may include linkers comprising cleavable groups which are known in the art.

Suitable linkers may include pH sensitive linkers. For example, certain suitable linkers may be chosen for their instability in lower pH environments to provide for dissociation inside a subcellular compartment of a target cell (see e.g., van Der Velden V et al., *Blood* 97: 3197-204 (2001); Ulbrich K, Subr V, *Adv Drug Deliv Rev* 56: 1023-50 (2004)). For example, linkers that comprise one or more trityl groups, derivatized trityl groups, bismaleimideothoxy propane groups, adipic acid dihydrazide groups, and/or acid labile transferrin groups, may provide for release of components of the cell-targeting molecules of the invention, e.g. a polypeptide component, in environments with specific pH ranges. In certain linkers may be chosen which are cleaved in pH ranges corresponding to physiological pH differences between tissues, such as, e.g., the pH of tumor tissue is lower than in healthy tissues.

Photocleavable linkers are linkers that are cleaved upon exposure to electromagnetic radiation of certain wavelength ranges, such as light in the visible range. Photocleavable linkers may be used to release a component of a cell-targeting molecule of the invention, e.g. a polypeptide component, upon exposure to light of certain wavelengths. Non-limiting examples of photocleavable linkers include a nitrobenzyl group as a photocleavable protective group for cysteine, nitrobenzyloxycarbonyl chloride cross-linkers, hydroxypropylmethacrylamide copolymer, glycine copolymer, fluorescein copolymer, and methylrhodamine copolymer. Photocleavable linkers may have particular uses in linking components to form cell-targeting molecules of the invention designed for treating diseases, disorders, and conditions that can be exposed to light using fiber optics.

In certain embodiments of the cell-targeting molecules of the present invention, a cell-targeting binding region is linked to a Shiga toxin effector polypeptide of the present invention using any number of means known to the skilled worker, including both covalent and noncovalent linkages.

In certain embodiments of the cell-targeting molecules of the present invention, the molecule comprises a binding region which is a scFv with a linker connecting a heavy chain variable ($V_H$) domain and a light chain variable ($V_L$) domain. There are numerous linkers known in the art suitable for this purpose, such as, e.g., the 15-residue $(Gy4Ser)_3$ peptide (SEQ ID NO:552). Suitable scFv linkers which may be used in forming non-covalent multivalent structures include GGS (SEQ ID NO:553), GGGS (SEQ ID NO:554), GGGGS (SEQ ID NO:555), GGGGSGGG (SEQ ID NO:556), GGSGGGG (SEQ ID NO:557), GSTSGGGSGGGSGGGGSS (SEQ ID NO:558), and GSTSGSGKPGSSEGSTKG (SEQ ID NO:559).

Suitable methods for linkage of the components of the cell-targeting molecules of the present invention may be by any method presently known in the art for accomplishing such, so long as the attachment does not substantially impede the binding capability of the cell-targeting binding region, the cellular internalization of the Shiga toxin effector polypeptide component, and/or when appropriate the desired Shiga toxin effector function(s) as measured by an appropriate assay, including assays described herein.

For the purposes of the cell-targeting molecules of the present invention, the specific order or orientation is not fixed for the components: the Shiga toxin effector polypeptide(s), the binding region(s), and any optional linker(s), in relation to each other or the entire cell-targeting molecule (see e.g. FIG. 1) unless specifically noted. The components of the cell-targeting molecules of the present invention may be arranged in any order provided that the desired activity(ies) of the binding region and Shiga toxin effector polypeptide are not eliminated.

IV. Examples of Structural Variations of the Shiga Toxin Effector Polypeptides and Cell-Targeting Molecules of the Invention In certain embodiments, a Shiga toxin effector polypeptide of the present invention may comprise or consist essentially of a truncated Shiga toxin A Subunit. Truncations of Shiga toxin A Subunits might result in the deletion of an entire epitope(s) and/or epitope region(s), B-cell epitopes, CD4+ T-cell epitopes, and/or furin-cleavage sites without affecting Shiga toxin effector functions, such as, e.g., catalytic activity and cytotoxicity. The smallest Shiga toxin A Subunit fragment shown to exhibit full enzymatic activity was a polypeptide composed of residues 1-239 of Slt1A (LaPointe P et al., *J Biol Chem* 280: 23310-18 (2005)). The smallest Shiga toxin A Subunit fragment shown to exhibit significant enzymatic activity was a polypeptide composed of residues 75-247 of StxA (Al-Jaufy A et al., *Infect Immun* 62: 956-60 (1994)).

Although Shiga toxin effector polypeptides of the present invention may commonly be smaller than the full-length Shiga toxin A Subunit, it is preferred that the Shiga toxin effector polypeptide region of a cell-targeting molecule of the present invention maintain the polypeptide region from amino acid position 77 to 239 (SLT-1A (SEQ ID NO:1) or StxA (SEQ ID NO:2)) or the equivalent in other A Subunits of members of the Shiga toxin family (e.g. 77 to 238 of (SEQ ID NO:3)). For example, in certain embodiments of the molecules of the present invention, the Shiga toxin effector polypeptides of the present invention derived from SLT-1A may comprise or consist essentially of amino acids 75 to 251 of SEQ ID NO:1, 1 to 241 of SEQ ID NO:1, 1 to 251 of SEQ ID NO:1, or amino acids 1 to 261 of SEQ ID NO:1, wherein relative to a wild-type Shiga toxin A Subunit at least one amino acid residue is mutated or has been deleted in an endogenous epitope and/or epitope region, and/or wherein there is a disrupted, furin-cleavage motif region at the carboxy-terminus of a Shiga toxin A1 fragment derived region. Similarly, Shiga toxin effector polypeptide regions derived from StxA may comprise or consist essentially of amino acids 75 to 251 of SEQ ID NO:2, 1 to 241 of SEQ ID NO:2, 1 to 251 of SEQ ID NO:2, or amino acids 1 to 261 of SEQ ID NO:2, wherein relative to a wild-type Shiga toxin A Subunit at least one amino acid residue is mutated or has been deleted in an endogenous epitope and/or epitope region, and/or wherein there is a disrupted, furin-cleavage motif region at the carboxy-terminus of a Shiga toxin A1 fragment derived region. Additionally, Shiga toxin effector polypeptide regions derived from SLT-2 may comprise or consist essentially of amino acids 75 to 251 of SEQ ID NO:3, 1 to 241 of SEQ ID NO:3, 1 to 251 of SEQ ID NO:3, or amino acids 1 to 261 of SEQ ID NO:3, wherein relative to a wild-type Shiga toxin A Subunit at least one amino acid residue is mutated or has been deleted in an endogenous epitope and/or epitope region, and/or wherein there is a disrupted, furin-cleavage motif region at the carboxy-terminus of a Shiga toxin A1 fragment derived region.

The invention further provides variants of Shiga toxin effector polypeptides and cell-targeting molecules of the present invention, wherein the Shiga toxin effector polypeptide differs from a naturally occurring Shiga toxin A Subunit by only or up to 1, 2, 3, 4, 5, 6, 7, 8, 9, 10, 15, 20, 25, 30, 35, 40 or more amino acid residues (but by no more than that which retains at least 85%, 90%, 95%, 99% or more amino acid sequence identity). Thus, a molecule of the present invention derived from an A Subunit of a member of the Shiga toxin family may comprise additions, deletions, truncations, or other alterations from the original sequence as long as at least 85%, 90%, 95%, 99% or more amino acid sequence identity is maintained to a naturally occurring Shiga toxin A Subunit and wherein relative to a wild-type Shiga toxin A Subunit at least one amino acid residue is mutated or has been deleted in an endogenous epitope and/or epitope region, and/or wherein there is a disrupted, furin-cleavage motif region at the carboxy-terminus of a Shiga toxin A1 fragment derived region.

Accordingly, in certain embodiments, the Shiga toxin effector polypeptide of a molecule of the present invention comprises or consists essentially of amino acid sequences having at least 55%, 60%, 65%, 70%, 75%, 80%, 85%, 90%, 95%, 97%, 98%, 99%, 99.5% or 99.7% overall sequence identity to a naturally occurring Shiga toxin A Subunit, such as SLT-1A (SEQ ID NO:1), StxA (SEQ ID NO:2), and/or SLT-2A (SEQ ID NO:3) wherein relative to a wild-type Shiga toxin A Subunit at least one amino acid residue is mutated or has been deleted in an endogenous epitope and/or epitope region, and/or wherein there is a disrupted, furin-cleavage motif region at the carboxy-terminus of a Shiga toxin A1 fragment derived region.

Optionally, either a full-length or a truncated version of the Shiga toxin A Subunit may comprise the Shiga toxin effector polypeptide region of a molecule of the present, wherein the Shiga toxin derived polypeptide comprises one or more mutations (e.g. substitutions, deletions, insertions, or inversions) as compared to a naturally occurring Shiga toxin. It is preferred in certain embodiments of the invention that the Shiga toxin effector polypeptides have sufficient sequence identity to a naturally occurring Shiga toxin A Subunit to retain cytotoxicity after entry into a cell, either by well-known methods of host cell transformation, transfection, infection or induction, or by internalization mediated by a cell-targeting binding region linked with the Shiga toxin effector polypeptide. The most critical residues for enzymatic activity and/or cytotoxicity in the Shiga toxin A Subunits have been mapped to the following residue-positions: asparagine-75, tyrosine-77, glutamate-167, arginine-170, and arginine-176 among others (Di R et al., *Toxicon* 57: 525-39 (2011)). In any one of the embodiments of the invention, the Shiga toxin effector polypeptides may preferably but not necessarily maintain one or more conserved amino acids at positions, such as those found at positions 77, 167, 170, and 176 in StxA, SLT-1A, or the equivalent conserved position in other members of the Shiga toxin family which are typically required for cytotoxic activity. The capacity of a cytotoxic molecule of the invention to cause cell death, e.g. its cytotoxicity, may be measured using any one or more of a number of assays well known in the art.

A. Examples of De-Immunized, Shiga Toxin Effector Polypeptides

In certain embodiments, the de-immunized, Shiga toxin effector polypeptide of the present invention may consist essentially of a truncated Shiga toxin A Subunit having two or more mutations. Truncations of Shiga toxin A Subunits might result in the deletion of an entire epitope(s) and/or epitope region(s), B-cell epitopes, CD4+ T-cell epitopes, and/or furin-cleavage sites without affecting Shiga toxin effector functions, such as, e.g., catalytic activity and cytotoxicity. Truncating the carboxy-terminus of SLT-1A, StxA, or SLT-2A to amino acids 1-251 removes two predicted B-cell epitope regions, two predicted CD4 positive (CD4+) T-cell epitopes, and a predicted discontinuous B-cell epitope. Truncating the amino-terminus of SLT-1A, StxA, or SLT-2A to 75-293 removes at least three predicted B-cell epitope regions and three predicted CD4+ T-cell epitopes. Truncating both amino- and carboxy-terminals of SLT-1A, StxA, or SLT-2A to 75-251 deletes at least five predicted B-cell epitope regions, four putative CD4+ T-cell epitopes and one predicted discontinuous B-cell epitope.

In certain embodiments, a de-immunized, Shiga toxin effector polypeptide of the present invention may comprise or consist essentially of a full-length or truncated Shiga toxin A Subunit with at least one mutation (relative to a wild-type Shiga toxin polypeptide), e.g. deletion, insertion, inversion, or substitution, in a provided, endogenous, B-cell and/or CD4+ T-cell epitope region. In certain embodiments, the Shiga toxin effector polypeptide of the present invention comprises a disruption which comprises a mutation (relative to a wild-type Shiga toxin polypeptide) which includes a deletion of at least one amino acid residue within the endogenous, B-cell and/or CD4+ T-cell epitope region. In certain embodiments, the Shiga toxin effector polypeptide of the present invention comprises a disruption which comprises an insertion of at least one amino acid residue within the endogenous, B-cell and/or CD4+ T-cell epitope region. In certain embodiments, the Shiga toxin effector polypeptide of the present invention comprises a disruption which comprises an inversion of amino acid residues, wherein at least one inverted amino acid residue is within the endogenous, B-cell and/or CD4+ T-cell epitope region. In certain embodiments, the Shiga toxin effector polypeptide of the present invention comprises a disruption which comprises a mutation (relative to a wild-type Shiga toxin polypeptide), such as, e.g., an amino acid substitution, an amino acid substitution to a non-standard amino acid, and/or an amino acid residue with a chemically modified side chain. Non-limiting examples of de-immunized, Shiga toxin effector sub-regions suitable for use in the present invention are described in WO 2015/113005, WO 2015/113007 and WO 2015/191764. Numerous, non-limiting examples of Shiga toxin effector polypeptides of the present invention which comprise amino acid substitutions are provided in the Examples.

In other embodiments, the de-immunized, Shiga toxin effector polypeptide of the present invention comprises a truncated Shiga toxin A Subunit which is shorter than a full-length Shiga toxin A Subunit wherein at least one amino acid residue is disrupted in a natively positioned, B-cell and/or CD4+ T-cell epitope region provided in the Examples (see e.g. Tables 1-7 and/or Table B).

To create a de-immunized, Shiga toxin effector polypeptide, in principle modifying any amino acid residue in a provided epitope region by various means can result in a disruption of an epitope, such as, e.g., a modification which represents a deletion, insertion, inversion, rearrangement, substitution, and chemical modification of a side chain relative to a wild-type Shiga toxin polypeptide. However, modifying certain amino acid residues and using certain amino acid modifications are more likely to successfully reduce antigenicity and/or immunogenicity while maintaining a certain level of a Shiga toxin effector function(s). For example, terminal truncations and internal amino acid substitutions are preferred because these types of modifications maintain the overall spacing of the amino acid residues in a Shiga toxin effector polypeptide and thus are more likely to maintain Shiga toxin effector polypeptide structure and function.

Among certain embodiments of the present invention, the de-immunized, Shiga toxin effector polypeptide comprising or consisting essentially of amino acids 75 to 251 of SLT-1A (SEQ ID NO:1), StxA (SEQ ID NO:2), and/or SLT-2A (SEQ ID NO:3) wherein at least one amino acid residue is disrupted in a natively positioned, epitope region provided in the Examples (see e.g. Tables 1-7 and/or 12). Among certain other embodiments are de-immunized, Shiga toxin effector polypeptides which comprise or consist essentially of amino acids 1 to 241 of SLT-1A (SEQ ID NO:1), StxA (SEQ ID NO:2), and/or SLT-2A (SEQ ID NO:3) wherein at least one amino acid residue is disrupted in a natively positioned, epitope region provided in the Examples (see e.g. Tables 1-7 and/or 12). Further embodiments are de-immunized, Shiga toxin effector polypeptides which comprise or consist essentially of amino acids 1 to 251 of SLT-1A (SEQ ID NO:1), StxA (SEQ ID NO:2), and/or SLT-2A (SEQ ID NO:3) wherein at least one amino acid residue is disrupted in a natively positioned, epitope region provided in the Examples (see e.g. Tables 1-7 and/or 12). Further embodiments are Shiga toxin effector polypeptides comprising amino acids 1 to 261 of SLT-1A (SEQ ID NO:1), StxA (SEQ ID NO:2), and/or SLT-2A (SEQ ID NO:3) wherein at least one amino acid residue is disrupted in a natively positioned, epitope region provided in the Examples (see e.g. Tables 1-7 and/or 12).

There are numerous, diverse, internal amino acid substitutions that can be used to create de-immunized, Shiga toxin effector polypeptides of the invention. Of the possible substitute amino acids to use within an epitope region, the following substitute amino acid residues are predicted to be the most likely to reduce the antigenicity and/or immunogenicity of an epitope G, D, E, S, T, R, K, and H. Except for glycine, these amino acid residues may all be classified as polar and/or charged residues. Of the possible amino acids to substitute with, the following amino acids A, G, V, L, I, P, C, M, F, S, D, N, Q, H, and K are predicted to be the most likely to reduce antigenicity and/or immunogenicity while providing the retention of a significant level of a Shiga toxin effector function(s), depending on the amino acid substituted for. Generally, the substitution should change a polar and/or charged amino acid residue to a non-polar and uncharged residue (see e.g. WO 2015/113005). In addition, it may be beneficial to epitope disruption to reduce the overall size and/or length of the amino acid residue's R-group functional side chain (see e.g. WO 2015/113005). However despite these generalities of substitutions most likely to confer epitope disruption, because the aim is to preserve significant Shiga toxin effector function(s), the substitute amino acid might be more likely to preserve Shiga toxin effector function(s) if it resembles the amino acid substituted for, such as, e.g., a nonpolar and/or uncharged residue of similar size substituted for a polar and/or charged residue.

In the Examples below and in WO2015/113005, many mutations have been empirically tested for effect(s) on the Shiga toxin effector function of various Shiga toxin effector polypeptides and cell-targeting molecules. Table B summarizes the results described in the Examples and in WO2015/113005 where an amino acid substitution, alone or in combination with one or more other substitutions, did not prevent the exhibition of a potent level of a Shiga toxin effector function(s). Table B uses the epitope region numbering scheme described in the Examples below (see Example 1-Table 7, infra).

TABLE B

| Amino Acid Substitutions in Shiga Toxin Effector Polypeptides | | | |
|---|---|---|---|
| Epitope Region | natively positioned amino acid positions | | |
| Disrupted | Substitution | B-Cell Epitope Region | T-Cell Epitope |
| 1 | K1A | 1-15 | |
| 1 | K1M | 1-15 | |
| 1 | T4I | 1-15 | 4-33 |
| 1 | D6R | 1-15 | 4-33 |
| 1 | S8I | 1-15 | 4-33 |
| 1 | T9V | 1-15 | 4-33 |
| 1 | T9I | 1-15 | 4-33 |
| 1 | K11A | 1-15 | 4-33 |
| 1 | K11H | 1-15 | 4-33 |
| 1 | T12K | 1-15 | 4-33 |
| 2 | S33I | 27-37 | 4-33 |
| 2 | S33C | 27-37 | 4-33 |
| 3 | S43N | 39-48 | 34-78 |
| 3 | G44L | 39-48 | 34-78 |
| 3 | T45V | 39-48 | 34-78 |
| 3 | T45I | 39-48 | 34-78 |
| 3 | S45V | 39-48 | 34-78 |
| 3 | S45I | 39-48 | 34-78 |
| 3 | G46P | 39-48 | 34-78 |
| 3 | D47G | 39-48 | 34-78 |
| 3 | D47M | 39-48 | 34-78 |
| 3 | N48V | 39-48 | 34-78 |
| 3 | N48F | 39-48 | 34-78 |
| — | L49A | immunogenic residue | 34-78 |
| — | F50T | | 34-78 |
| — | A51V | | 34-78 |
| 4 | D53A | 53-66 | 34-78 |
| 4 | D53G | 53-66 | 34-78 |
| 4 | D53N | 53-66 | 34-78 |
| 4 | V54L | 53-66 | 34-78 |
| 4 | V54I | 53-66 | 34-78 |
| 4 | R55A | 53-66 | 34-78 |
| 4 | R55V | 53-66 | 34-78 |
| 4 | R55L | 53-66 | 34-78 |
| 4 | G56P | 53-66 | 34-78 |
| 4 | I57M | 53-66 | 34-78 |
| 4 | I57F | 53-66 | 34-78 |
| 4 | D58A | 53-66 | 34-78 |
| 4 | D58V | 53-66 | 34-78 |
| 4 | D58F | 53-66 | 34-78 |
| 4 | P59A | 53-66 | 34-78 |
| 4 | P59F | 53-66 | 34-78 |
| 4 | E60I | 53-66 | 34-78 |
| 4 | E60T | 53-66 | 34-78 |
| 4 | E60R | 53-66 | 34-78 |
| 4 | E61A | 53-66 | 34-78 |
| 4 | E61V | 53-66 | 34-78 |
| 4 | E61L | 53-66 | 34-78 |
| 4 | G62A | 53-66 | 34-78 |
| — | R84A | | 77-103 |
| — | V88A | | 77-103 |
| 5 | D94A | 94-115 | 77-103 |
| 5 | S96I | 94-115 | 77-103 |
| 5 | T104N | 94-115 | |
| 5 | A105L | 94-115 | |
| 5 | T107P | 94-115 | |
| 5 | L108M | 94-115 | |
| 5 | S109V | 94-115 | |
| 5 | G110A | 94-115 | |
| 5 | D111T | 94-115 | |
| 5 | S112V | 94-115 | |
| 6 | D141A | 141-153 | 128-168 |
| 6 | G147A | 141-153 | 128-168 |
| — | V154A | | 128-168 |
| 7 | R179A | 179-190 | 160-183 |
| 7 | T180G | 179-190 | 160-183 |
| 7 | T181I | 179-190 | 160-183 |
| 7 | D183A | 179-190 | 160-183 |
| 7 | D183G | 179-190 | 160-183 |

TABLE B-continued

| Amino Acid Substitutions in Shiga Toxin Effector Polypeptides | | | |
|---|---|---|---|
| Epitope Region | natively positioned amino acid positions | | |
| Disrupted | Substitution | B-Cell Epitope Region | T-Cell Epitope |
| 7 | D184A | 179-190 | |
| 7 | D184F | 179-190 | |
| 7 | L185V | 179-190 | |
| 7 | S186A | 179-190 | |
| 7 | S186F | 179-190 | |
| 7 | G187A | 179-190 | |
| 7 | G187T | 179-190 | |
| 7 | R188A | 179-190 | |
| 7 | R188L | 179-190 | |
| 7 | S189A | 179-190 | |
| — | D198A | immunogenic residue | |
| — | R205A | immunogenic residue | |
| — | C242S | | 236-258 |
| 8 | R248A | 243-257 | 236-258 |
| 8 | R251A | 243-257 | 236-258 |

Based on the empirical evidence in the Examples herein and in WO 2015/113005, certain amino acid positions in the A Subunits of Shiga toxins are predicted to tolerate epitope disruptions while still retaining significant Shiga toxin effector functions. For example, the following natively occurring positions tolerate amino acid substitutions, either alone or in combination, while retaining a Shiga toxin effector function(s) such as cytotoxicity 1 of SEQ ID NO:1 or SEQ ID NO: 2; 4 of SEQ ID NO: 1, SEQ ID NO: 2, or SEQ ID NO: 3; 8 of SEQ ID NO: 1, SEQ ID NO: 2, or SEQ ID NO: 3; 9 of SEQ ID NO: 1, SEQ ID NO: 2, or SEQ ID NO: 3; 11 of SEQ ID NO: 1, SEQ ID NO: 2, or SEQ ID NO: 3; 33 of SEQ ID NO:1 or SEQ ID NO:2; 43 of SEQ ID NO:1 or SEQ ID NO:2; 44 of SEQ ID NO:1 or SEQ ID NO:2; 45 of SEQ ID NO:1 or SEQ ID NO:2; 46 of SEQ ID NO:1 or SEQ ID NO:2; 47 of SEQ ID NO:1 or SEQ ID NO:2; 48 of SEQ ID NO:1, SEQ ID NO:2, or SEQ ID NO:3; 49 of SEQ ID NO:1 or SEQ ID NO:2; 50 of SEQ ID NO:1 or SEQ ID NO:2; 51 of SEQ ID NO:1 or SEQ ID NO:2; 53 of SEQ ID NO:1 or SEQ ID NO:2; 54 of SEQ ID NO:1 or SEQ ID NO:2; 55 of SEQ ID NO:1 or SEQ ID NO:2; 56 of SEQ ID NO:1 or SEQ ID NO:2; 57 of SEQ ID NO:1 or SEQ ID NO:2; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 84 of SEQ ID NO:1 or SEQ ID NO:2; 88 of SEQ ID NO:1 or SEQ ID NO:2; 94 of SEQ ID NO:1, SEQ ID NO:2, or SEQ ID NO:3; 96 of SEQ ID NO:1, SEQ ID NO:2, or SEQ ID NO:3; 104 of SEQ ID NO:1 or SEQ ID NO:2; 105 of SEQ ID NO:1 or SEQ ID NO:2; 107 of SEQ ID NO:1 or SEQ ID NO:2; 108 of SEQ ID NO:1 or SEQ ID NO:2; 109 of SEQ ID NO:1, SEQ ID NO:2, or SEQ ID NO:3; 110 of SEQ ID NO:1 or SEQ ID NO:2; 111 of SEQ ID NO:1 or SEQ ID NO:2; 112 of SEQ ID NO:1, SEQ ID NO:2, or SEQ ID NO:3; 141 of SEQ ID NO:1 or SEQ ID NO:2; 147 of SEQ ID NO:1, SEQ ID NO:2, or SEQ ID NO:3; 154 of SEQ ID NO:1 or SEQ ID NO:2; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 198 of SEQ ID NO:1 or SEQ ID NO:2; 204 of SEQ ID NO:3; 205 of SEQ ID NO:1 or SEQ ID NO:2; 241 of SEQ ID NO:3; 242 of SEQ ID NO:1 or SEQ ID NO:2; 247 of SEQ ID NO:1 or SEQ ID NO:2; 247 of SEQ ID NO:3; 248 of SEQ ID NO:1 or SEQ ID NO:2; 250 of SEQ ID NO:3; 251 of SEQ ID NO:1 or SEQ ID NO:2; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2.

The empirical data in the Examples and in WO 2015/113005 point towards other epitope disrupting substitutions and combinations of epitope disrupting substitutions that can reduce antigenicity and/or immunogenicity of a Shiga toxin effector polypeptide while retaining the ability of the Shiga toxin effector polypeptide to exhibit a significant Shiga toxin effector function such as, e.g., new combinations of the aforementioned truncations and positions tolerating substitutions as well as new substitutions at identical positions or conserved positions in related Shiga toxin A Subunits.

It is predictable that other amino acid substitutions to amino acid residues of a conservative functional group of a substitution tested herein may reduce antigenicity and/or immunogenicity while preserving a significant Shiga toxin effector function. For example, other substitutions known to the skilled worker to be similar to any of K1A, K1M, T4I, D6R, S8I, T8V, T9I, S9I, K11A, K11H, T12K, S33I, S33C, S43N, G44L, S45V, S45I, T45V, T45I, G46P, D47M, D47G, N48V, N48F, L49A, F50T, A51V, D53A, D53N, D53G, V54L, V54I, R55A, R55V, R55L, G56P, I57F, I57M, D58A, D58V, D58F, P59A, P59F, E60, E60T, E60R, E61A, E61V, E61L, G62A, R84A, V88A, D94A, S96I, T104N, A105L, T107P, L108M, S109V, T109V, G110A, D111T, S112V, D141A, G147A, V154A, R179A, T180G, T181I, D183A, D183G, D184A, D184A, D184F, L185V, L185D, S186A, S186F, G187A, G187T, R188A, R188L, S189A, D198A, R204A, R205A, C242S, S247I, Y247A, R248A, R250A, R251A, or D264A, G264A, T286A, and/or T286I may disrupt an endogenous epitope while maintaining at least one Shiga toxin effector function. In particular, amino acid substitutions to conservative amino acid residues similar to K1A, K1M, T4I, S8I, T8V, T9I, S9I, K11A, K11H, S33I, S33C, S43N, G44L, S45V, S45I, T45V, T45I, G46P, D47M, N48V, N48F, L49A, A51V, D53A, D53N, V54L, V54I, R55A, R55V, R55L, G56P, I57F, I57M, D58A, D58V, D58F, P59A, E60I, E60T, E61A, E61V, E61L, G62A, R84A, V88A, D94A, S96I, T104N, T107P, L108M, S109V, T109V, G110A, D111T, S112V, D141A, G147A, V154A, R179A, T180G, T181I, D183A, D183G, D184A, D184F, L185V, S186A, S186F, G187A, R188A, R188L, S189A, D198A, R204A, R205A, C242S, S247I, Y247A, R248A, R250A, R251A, D264A, G264A, T286A, and T286I may have the same or similar effects. In certain embodiments, a Shiga toxin effector polypeptide of the invention may comprise similar conservative amino acid substitutions to empirically tested ones, such as, e.g., K1 to G, V, L, I, F, and H; T4 to A, G, V, L, F, M, and S; S8 to A, G, V, L, F, and M; T9 to A, G, L, F, M, and S; S9 to A, G, L, I, F, and M; K11 to G, V, L, I, F, and M; S33 to A, G, V, L, F, and M; S43 to A, G, V, L, I, F, and M; S45 to A, G, L, F, and M; T45 to A, G, L, F, and M; D47 to A, V, L, I, F, S, and Q; N48 to A, G, L, and M; L49 to G; Y49 to A; D53 to V, L, I, F, S, and Q; R55 to G, I, F, M, Q, S, K, and H; D58 to G, L, I, S, and Q; P59 to G; E60 to A, G, V, L, F, S, Q, N, D, and M; E61 to G, I, F, S, Q, N, D, M, and R; R84 to G, V, L, I, F, M, Q, S, K, and H; V88 to G; 188 to G; D94 to G, V, L, I, F, S, and Q; S96 to A, G, V, L, F, and M; T107 to A, G, V, L, I, F, M, and S; S107 to A, G, V, L, I, F, and M; S109 to A, G, I, L, F, and M; T109 to A, G, I, L, F, M, and S; S112 to A, G, L, I, F, and M; D141 to V, L, I, F, S, and Q; V154 to G; R179 to G, V, L, I, F, M, Q, S, K, and H; T180 to A, V, L, I, F, M, and S; T181 to A, G, V, L, F, M, and S; D183 to V, L, I, F, S, and Q; D184 to G, V, L, I, S, and Q; S186 to G, V, I, L, and M; R188 to G, V, I, F, M, Q, S, K, and H; S189 to G, V, I, L, F, and M; D197 to V, L, I, F, S, and Q; D198 to A, V, L, I, F, S, and Q; R204 to G, V, L, I, F, M, Q, S, K, and H; R205 to G, V, L, I, F, M, Q, S, K and H; S247 to A, G, V, I, L, F, and M; Y247 to A, G, V, L, I, F, and M; R248 to G, V, L, I, F, M, Q, S, K, and H; R250 to G, V, L, I, F, M, Q, S, K, and H; R251 to G, V, L, I, F, M, Q, S, K, and H; D264 to A, G, V, L, I, F, S, and Q; and T286 to A, G, V, L, I, F, M, and S.

Similarly, amino acid substitutions which remove charge, polarity, and/or reduce side chain length can disrupt an epitope while maintaining at least one Shiga toxin effector function. In certain embodiments, a Shiga toxin effector polypeptide of the invention may comprise one or more epitopes disrupted by substitutions such that side chain charge is removed, polarity is removed, and/or side chain length is reduced such as, e.g., substituting the appropriate amino acid selected from the following group A, G, V, L, I, P, C, M, F, S, D, N, Q, H, or K for the amino acid residue at position 1 of SEQ ID NO:1 or SEQ ID NO:2; 4 of SEQ ID NO:1, SEQ ID NO:2, or SEQ ID NO:3; 6 of SEQ ID NO:1 or SEQ ID NO:2; 8 of SEQ ID NO:1, SEQ ID NO:2, or SEQ ID NO:3; 9 of SEQ ID NO:1, SEQ ID NO:2, or SEQ ID NO:3; 11 of SEQ ID NO:1, SEQ ID NO:2, or SEQ ID NO:3; 12 of SEQ ID NO:1, SEQ ID NO:2, or SEQ ID NO:3; 33 of SEQ ID NO:1 or SEQ ID NO:2; 43 of SEQ ID NO:1 or SEQ ID NO:2; 44 of SEQ ID NO:1 or SEQ ID NO:2; 45 of SEQ ID NO:1 or SEQ ID NO:2; 46 of SEQ ID NO:1 or SEQ ID NO:2; 47 of SEQ ID NO:1 or SEQ ID NO:2; 48 of SEQ ID NO:1, SEQ ID NO:2, or SEQ ID NO:3; 49 of SEQ ID NO:1 or SEQ ID NO:2; 50 of SEQ ID NO:1 or SEQ ID NO:2; 51 of SEQ ID NO:1 or SEQ ID NO:2; 53 of SEQ ID NO:1 or SEQ ID NO:2; 54 of SEQ ID NO:1 or SEQ ID NO:2; 55 of SEQ ID NO:1 or SEQ ID NO:2; 56 of SEQ ID NO:1 or SEQ ID NO:2; 57 of SEQ ID NO:1, SEQ ID NO:2, or SEQ ID NO:3; 58 of SEQ ID NO:1, SEQ ID NO:2, or SEQ ID NO:3; 59 of SEQ ID NO:1, SEQ ID NO:2, or SEQ ID NO:3; 60 of SEQ ID NO:1 or SEQ ID NO:2; 61 of SEQ ID NO:1 or SEQ ID NO:2; 62 of SEQ ID NO:1 or SEQ ID NO:2; 84 of SEQ ID NO:1 or SEQ ID NO:2; 88 of SEQ ID NO:1, SEQ ID NO:2, or SEQ ID NO:3; 94 of SEQ ID NO:1, SEQ ID NO:2, or SEQ ID NO:3; 96 of SEQ ID NO:1, SEQ ID NO:2, or SEQ ID NO:3; 104 of SEQ ID NO:1 or SEQ ID NO:2; 105 of SEQ ID NO:1 or SEQ ID NO:2; 107 of SEQ ID NO:1, SEQ ID NO:2, or SEQ ID NO:3; 108 of SEQ ID NO:1 or SEQ ID NO:2; 109 of SEQ ID NO:1, SEQ ID NO:2, or SEQ ID NO:3; 110 of SEQ ID NO:1 or SEQ ID NO:2; 111 of SEQ ID NO:1 or SEQ ID NO:2; 112 of SEQ ID NO:1, SEQ ID NO:2, or SEQ ID NO:3; 141 of SEQ ID NO:1 or SEQ ID NO:2; 147 of SEQ ID NO:1, SEQ ID NO:2, or SEQ ID NO:3; 154 of SEQ ID NO:1 or SEQ ID NO:2; 179 of SEQ ID NO:1, SEQ ID NO:2, or SEQ ID NO:3; 180 of SEQ ID NO:1 or SEQ ID NO:2; 181 of SEQ ID NO:1 or SEQ ID NO:2; 183 of SEQ ID NO:1, SEQ ID NO:2, or SEQ ID NO:3; 184 of SEQ ID NO:1, SEQ ID NO:2, or SEQ ID NO:3; 185 of SEQ ID NO:1 or SEQ ID NO:2; 186 of SEQ ID NO:1, SEQ ID NO:2, or SEQ ID NO:3; 187 of SEQ ID NO:1 or SEQ ID NO:2; 188 of SEQ ID NO:1 or SEQ ID NO:2; 189 of SEQ ID NO:1 or SEQ ID NO:2; 197 of SEQ ID NO:3; 198 of SEQ ID NO:1 or SEQ ID NO:2; 204 of SEQ ID NO:3; 205 of SEQ ID NO:1 or SEQ ID NO:2; 241 of SEQ ID NO:3; 242 of SEQ ID NO:1 or SEQ ID NO:2; 247 of SEQ ID NO:1 or SEQ ID NO:2;

247 of SEQ ID NO:3; 248 of SEQ ID NO:1 or SEQ ID NO:2; 250 of SEQ ID NO:3; 251 of SEQ ID NO:1 or SEQ ID NO:2; 264 of SEQ ID NO:1, SEQ ID NO:2, or SEQ ID NO:3; 265 of SEQ ID NO:1 or SEQ ID NO:2; and 286 of SEQ ID NO:1 or SEQ ID NO:2. In certain embodiments, a Shiga toxin effector polypeptide of the present invention may comprise one or more of the following amino acid substitutions: K1 to A, G, V, L, I, F, M and H; T4 to A, G, V, L, I, F, M, and S; D6 to A, G, V, L, I, F, S, and Q; S8 to A, G, V, I, L, F, and M; T8 to A, G, V, I, L, F, M, and S; T9 to A, G, V, I, L, F, M, and S; S9 to A, G, V, L, I, F, and M; K11 to A, G, V, L, I, F, M and H; T12 to A, G, V, I, L, F, M, and S; S33 to A, G, V, L, I, F, and M; S43 to A, G, V, L, I, F, and M; G44 to A and L; S45 to A, G, V, L, I, F, and M; T45 to A, G, V, L, I, F, and M; G46 to A and P; D47 to A, G, V, L, I, F, S, and Q; N48 to A, G, V, L, and M; L49 to A or G; F50; A51 to V; D53 to A, G, V, L, I, F, S, and Q; V54 to A, G, and L; R55 to A, G, V, L, I, F, M, Q, S, K, and H; G56 to A and P; 157 to A, G, M, and F; L57 to A, G, M, and F; D58 to A, G, V, L, I, F, S, and Q; P59 to A, G, and F; E60 to A, G, V, L, I, F, S, Q, N, D, M, and R; E61 to A, G, V, L, I, F, S, Q, N, D, M, and R; G62 to A; D94 to A, G, V, L, I, F, S, and Q; R84 to A, G, V, L, I, F, M, Q, S, K, and H; V88 to A and G; 188 to A, G, and V; D94; S96 to A, G, V, I, L, F, and M; T104 to A, G, V, I, L, F, M, and S; A105 to L; T107 to A, G, V, I, L, F, M, and S; S107 to A, G, V, L, I, F, and M; L108 to A, G, and M; S109 to A, G, V, I, L, F, and M; T109 to A, G, V, I, L, F, M, and S; G110 to A; D111 to A, G, V, L, I, F, S, and Q; S112 to A, G, V, L, I, F, and M; D141 to A, G, V, L, I, F, S, and Q; G147 to A; V154 to A and G; R179 to A, G, V, L, I, F, M, Q, S, K, and H; T180 to A, G, V, L, I, F, M, and S; T181 to A, G, V, L, I, F, M, and S; D183 to A, G, V, L, I, F, S, and Q; D184 to A, G, V, L, I, F, S, and Q; L185 to A, G, and V; 5186 to A, G, V, I, L, F, and M; G187 to A; R188 to A, G, V, L, I, F, M, Q, S, K, and H; S189 to A, G, V, I, L, F, and M; D197 to A, G, V, L, I, F, S, and Q; D198 to A, G, V, L, I, F, S, and Q; R204 to A, G, V, L, I, F, M, Q, S, K, and H; R205 to A, G, V, L, I, F, M, Q, S, K and H; C242 to A, G, V, and S; S247 to A, G, V, I, L, F, and M; Y247 to A, G, V, L, I, F, and M; R248 to A, G, V, L, I, F, M, Q, S, K, and H; R250 to A, G, V, L, I, F, M, Q, S, K, and H; R251 to A, G, V, L, I, F, M, Q, S, K, and H; C262 to A, G, V, and S; D264 to A, G, V, L, I, F, S, and Q; G264 to A; and T286 to A, G, V, L, I, F, M, and S.

In addition, any amino acid substitution in one epitope region of a Shiga toxin effector polypeptide which disrupts an epitope while retaining significant Shiga toxin effector function is combinable with any other amino acid substitution in the same or a different epitope region which disrupts an epitope while retaining significant Shiga toxin effector function to form a de-immunized, Shiga toxin effector polypeptide with multiple epitope regions disrupted while still retaining a significant level of Shiga toxin effector function. In certain embodiments, a Shiga toxin effector polypeptide of the invention may comprise a combinations of two or more of the aforementioned substitutions and/or the combinations of substitutions described in WO 2015/113005.

Based on the empirical evidence in the Examples and in WO 2015/113005, certain amino acid regions in the A Subunits of Shiga toxins are predicted to tolerate epitope disruptions while still retaining significant Shiga toxin effector functions. For example, the epitope regions natively positioned at 1-15, 39-48, 53-66, 55-66, 94-115, 180-190, 179-190, and 243-257 tolerated multiple amino acid substitution combinations simultaneously without compromising Shiga toxin enzymatic activity and cytotoxicity.

B. Examples of Furin-Cleavage Resistant, Shiga Toxin Effector Polypeptides

In certain embodiments, the Shiga toxin effector polypeptide of the present invention may comprise a disrupted, furin cleavage motif and/or furin cleavage site at the carboxy-terminus of a Shiga toxin A1 fragment derived region. In certain further embodiments, the Shiga toxin effector polypeptide does not comprise any known compensatory structure which may provide furin cleavage proximal to the carboxy-terminus of the Shiga toxin A1 fragment derived region. Non-limiting examples of disrupted furin cleavage motifs and furin cleave sites suitable for use in the present invention are described in WO 2015/191764.

Certain furin-cleavage motif disruptions are indicated herein by reference to specific amino acid positions of native Shiga toxin A Subunits provided in the Sequence Listing, noting that naturally occurring Shiga toxin A Subunits includes precursor forms containing signal sequences of about 22 amino acids at their amino-terminals which are removed to produce mature Shiga toxin A Subunits and are recognizable to the skilled worker. Further, certain furin-cleavage motif disruptions comprising mutations are indicated herein by reference to specific amino acids (e.g. R for an arginine residue) natively present at specific positions within native Shiga toxin A Subunits (e.g. R251 for the arginine residue at position 251 from the amino-terminus) followed by the amino acid with which that residue has been substituted in the particular mutation under discussion (e.g. R251A represents the amino acid substitution of alanine for arginine at amino acid residue 251 from the amino-terminus).

In certain embodiments, the Shiga toxin effector polypeptide of the present invention comprises a disrupted furin-cleavage motif at the carboxy-terminus of a Shiga toxin A1 fragment derived region, and such embodiments are referred to herein as "furin-cleavage resistant" or "protease-cleavage resistant," Shiga toxin effector polypeptides to describe their property(ies) relative to wild-type, Shiga toxin A Subunits and/or wild-type, Shiga toxin A1 fragment fusion proteins.

In certain embodiments, the protease-cleavage resistant, Shiga toxin effector polypeptide of the present invention consists essentially of a truncated Shiga toxin A Subunit having two or more mutations.

In certain embodiments, the protease-cleavage resistant, Shiga toxin effector polypeptide of the present invention comprises the disrupted furin-cleavage motif comprising the amino acid residue substitution (relative to a wild-type Shiga toxin polypeptide) of one or both of the arginine residues in the minimal, furin-cleavage site consensus motif with A, G, or H. In certain embodiments, the protease-cleavage resistant, Shiga toxin effector polypeptide of the present invention comprises a disruption which comprises an amino acid substitution within a furin-cleavage motif region, where in the substitution occurs at the natively positioned amino acid selected from the group consisting of: 247 of SEQ ID NO:3, 248 of SEQ ID NO:1 or SEQ ID NO:2, 250 of SEQ ID NO:3, 251 of SEQ ID NO:1 or SEQ ID NO:2, or the equivalent position in a conserved Shiga toxin effector polypeptide and/or non-native Shiga toxin effector polypeptide sequence. In certain further embodiments, the substitution is to any non-conservative amino acid and the substitution occurs at the natively positioned amino acid residue position. In certain further embodiments, the mutation comprises an amino acid substitution selected from the group consisting of: R247A, R248A, R250A R251A, or the equivalent position in a conserved Shiga toxin effector polypeptide and/or non-native Shiga toxin effector polypeptide sequence.

In certain embodiments, the protease-cleavage resistant, Shiga toxin effector polypeptide of the present invention comprises the disrupted furin-cleavage motif comprising the mutation which is a deletion. In certain further embodiments, the disrupted furin-cleavage motif comprises a mutation which is a deletion of the region natively positioned at 247-252 in StxA (SEQ ID NO:2) and SLT-1A (SEQ ID NO:3), or the region natively positioned at 246-251 in SLT-2A (SEQ ID NO:3); a deletion of the region natively positioned at 244-246 in StxA (SEQ ID NO:2) and SLT-1A (SEQ ID NO:3), or the region natively positioned at 243-245 in SLT-2A (SEQ ID NO:3); or a deletion of the region natively positioned at 253-259 in StxA (SEQ ID NO:2) and SLT-1A (SEQ ID NO:3), or the region natively positioned at 252-258 in SLT-2A (SEQ ID NO:3).

In certain embodiments of the protease-cleavage resistant, Shiga toxin effector polypeptide of the present invention, the disrupted furin-cleavage motif comprises the mutation which is a carboxy-terminal truncation as compared to a wild-type Shiga toxin A Subunit, the truncation which results in the deletion of one or more amino acid residues within the furin-cleavage motif. In certain further embodiments, the disrupted furin-cleavage motif comprises the carboxy-terminal truncation which deletes one or more amino acid residues within the minimal cleavage site Y/R-x-x-R, such as, e.g., for StxA and SLT-1A derived Shiga toxin effector polypeptides, truncations ending at the natively amino acid residue position 250, 249, 248, 247, 246, 245, 244, 243, 242, 241, 240, or less; and for SLT-2A derived Shiga toxin effector polypeptides, truncations ending at the natively amino acid residue position 249, 248, 247, 246, 245, 244, 243, 242, 241, or less. Certain further embodiments comprise the disrupted furin-cleavage motif comprising a combination of any of the aforementioned mutations, where possible.

In certain embodiments, the disrupted furin-cleavage motif comprises the mutation(s) that is a partial, carboxy-terminal truncation of the furin-cleavage motif, however, certain molecules of the present invention do not comprise the disrupted furin-cleavage motif which is a complete, carboxy-terminal truncation of the entire 20 amino acid residue, furin-cleavage motif. For example, certain, Shiga toxin effector polypeptides of the present invention comprise the disrupted furin-cleavage motif comprising a partial, carboxy-terminal truncation of the Shiga toxin A1 fragment region up to native position 240 in StxA (SEQ ID NO:2) or SLT-1A (SEQ ID NO:1) but not a carboxy-terminal truncation at position 239 or less. Similarly, certain, certain, Shiga toxin effector polypeptides of the present invention comprise the disrupted furin-cleavage motif comprising a partial, carboxy-terminal truncation of the Shiga toxin A1 fragment region up to native position 239 in SLT-2A (SEQ ID NO:3) but not a carboxy-terminal truncation at position 238 or less. In the largest carboxy-terminal truncation of the furin-cleavage resistant, Shiga toxin effector polypeptide of the present invention, mutations comprising the disrupted furin-cleavage motif, positions P14 and P13 of the furin-cleavage motif are still present.

In certain embodiments, the disrupted furin-cleavage motif comprises both an amino acid residue substitution within the furin-cleavage motif and a carboxy-terminal truncation as compared to a wild-type, Shiga toxin A Subunit. In certain further embodiments, the disrupted furin-cleavage motif comprises both an amino acid residue substitution within the minimal furin-cleavage site R/Y-x-x-R and a carboxy-terminal truncation as compared to a wild-type, Shiga toxin A Subunit, such as, e.g., for StxA and SLT-1A derived Shiga toxin effector polypeptides, truncations ending at the natively amino acid residue position 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, or greater and comprising the natively positioned amino acid residue R248 and/or R251 substituted with any non-positively charged, amino acid residue where appropriate; and for SLT-2A derived Shiga toxin effector polypeptides, truncations ending at the natively amino acid residue position 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, or greater and comprising the natively positioned amino acid residue Y247 and/or R250 substituted with any non-positively charged, amino acid residue where appropriate. In certain embodiments, the truncated Shiga toxin effector polypeptide comprising a disrupted furin-cleavage motif also comprises the furin-cleavage motif, amino acid residues at positions P9, P8, and/or P7 in order to maintain optimal cytotoxicity.

In certain embodiments, the disrupted furin-cleavage motif comprises a mutation(s) which is one or more internal, amino acid residue deletions, as compared to a wild-type, Shiga toxin A Subunit. In certain further embodiments, the disrupted furin-cleavage motif comprises a mutation(s) which has one or more amino acid residue deletions within the minimal furin-cleavage site R/Y-x-x-R. For example, StxA and SLT-1A derived Shiga toxin effector polypeptides comprising internal deletions of the natively positioned amino acid residues R248 and/or R251, which may be combined with deletions of surrounding residues such as, e.g., 249, 250, 247, 252, etc.; and SLT-2A derived Shiga toxin effector polypeptides comprising internal deletions of the natively positioned amino acid residues Y247 and/or R250, which may be combined with deletions of surrounding residues such as, e.g., 248, 249, 246, 251, etc. In certain further embodiments, the disrupted furin-cleavage motif comprises a mutation which is a deletion of four, consecutive, amino acid residues which deletes the minimal furin-cleavage site R/Y-x-x-R, such as, e.g., StxA and SLT-1A derived Shiga toxin effector polypeptides lacking R248-R251 and SLT-2A derived Shiga toxin effector polypeptides lacking Y247-R250. In certain further embodiments, the disrupted furin-cleavage motif comprises a mutation(s) having one or more amino acid residue deletions in the amino acid residues flanking the core furin-cleavage motif, such as, e.g., a deletion of 244-247 and/or 252-255 in SLT-1A or StxA. In certain further embodiments, the disrupted furin-cleavage motif comprises a mutation which is an internal deletion of the entire surface-exposed, protease-cleavage sensitive loop as compared to a wild-type, Shiga toxin A Subunit, such as, e.g., for StxA and SLT-1A derived Shiga toxin effector polypeptides, a deletion of natively positioned amino acid residues 241-262; and for SLT-2A derived Shiga toxin effector polypeptides, a deletion of natively positioned amino acid residues 240-261.

In certain embodiments, the disrupted furin-cleavage motif comprises both a mutation which is an internal, amino acid residue deletion within the furin-cleavage motif and a mutation which is carboxy-terminal truncation as compared to a wild-type, Shiga toxin A Subunit. In certain further embodiments, the disrupted furin-cleavage motif comprises both a mutation which is an amino acid residue deletion within the minimal furin-cleavage site R/Y-x-x-R and a mutation which is a carboxy-terminal truncation as compared to a wild-type, Shiga toxin A Subunit. For example, protease-cleavage resistant, Shiga toxin effector polypeptides may comprise a disrupted furin-cleavage motif comprising mutation(s) which are deletions of the natively positioned amino acid residues 248-249 and/or 250-251 in a truncated StxA or SLT-1A polypeptide which still has amino acid residue 247 and/or 252, or the amino acid residues 247-248 and/or 249-250 in a truncated SLT-2A which still has amino acid residue 246 and/or 251. In certain further embodiments, the disrupted furin-cleavage motif comprises a mutation having a deletion of four, consecutive, amino acid residues which deletes the minimal furin-cleavage site R/Y-x-x-R and a carboxy-terminal truncation as compared to a wild-type, Shiga toxin A Subunit, such as, e.g., for StxA and SLT-1A derived Shiga toxin effector polypeptides, truncations ending at the natively amino acid residue position 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, or greater and lacking R248-R251; and for SLT-2A derived Shiga toxin effector polypeptides, truncations ending at the natively amino acid residue position 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, or greater and lacking Y247-R250.

C. Examples of Shiga Toxin Effector Polypeptides Having an Embedded Epitope

In certain embodiments, the Shiga toxin effector polypeptide of the present invention may comprise one or more embedded or inserted, heterologous, T-cell epitopes for purposes of de-immunization and/or delivery to a MHC class I presentation pathway of a target cell. For certain embodiments and/or certain Shiga toxin effector polypeptide sub-regions, embedding or partial embedding a T-cell epitope may be preferred over inserting a T-cell epitope because, e.g., embedding-type modifications are more likely to be successful in diverse sub-regions of a Shiga toxin effector polypeptide whereas successful insertions may be more limited to a smaller subset of Shiga toxin effector polypeptide sub-regions. The term “successful” is used here to mean the modification to the Shiga toxin effector polypeptide (e.g. introduction of a heterologous, T-cell epitope) results in a modified Shiga toxin effector polypeptide which retains one or more Shiga toxin effector functions at the requisite level of activity either alone or as a component of a cell-targeting molecule.

Any of the Shiga toxin effector polypeptide sub-regions described in WO 2015/113007 may be suitable for certain embodiments of the present invention, and any of the Shiga toxin effector polypeptides described in WO 2015/113007 may be modified into a Shiga toxin effector polypeptide of the present invention, e.g., by the addition of one or more new epitope region disruptions for de-immunization (such one as described herein) and/or a furin-cleavage motif disruption (such as one described herein).

In certain embodiments, the Shiga toxin effector polypeptide of the present invention consists essentially of a truncated Shiga toxin A Subunit comprising an embedded or inserted, heterologous, T-cell epitope and one or more other mutations. In certain embodiments, the Shiga toxin effector polypeptide of the present invention comprises an embedded or inserted, heterologous, T-cell epitope and is smaller than a full-length, Shiga toxin A Subunit, such as, e.g., consisting of the polypeptide represent by amino acids 77 to 239 of SLT-1A (SEQ ID NO:1) or StxA (SEQ ID NO:2) or the equivalent in other A Subunits of members of the Shiga toxin family (e.g. amino acids 77 to 238 of SLT-2A (SEQ ID NO:3)). For example, in certain embodiments of the present invention, the Shiga toxin effector polypeptides is derived from amino acids 75 to 251 of SEQ ID NO:1, 1 to 241 of SEQ ID NO:1, 1 to 251 of SEQ ID NO:1, or amino acids 1 to 261 of SEQ ID NO:1, wherein the Shiga toxin effector polypeptide comprises at least one embedded or inserted, heterologous T-cell epitope and at least one amino acid is disrupted in an endogenous, B-cell and/or CD4+ T-cell epitope region provided in the Examples (see e.g. Tables 1-7 and/or 12) and wherein the disrupted amino acid does not overlap with the embedded or inserted epitope. Similarly in other embodiments, the Shiga toxin effector polypeptide of the present invention is derived from amino acids 75 to 251 of SEQ ID NO:2, 1 to 241 of SEQ ID NO:2, 1 to 251 of SEQ ID NO:2, or amino acids 1 to 261 of SEQ ID NO:2, wherein the Shiga toxin effector polypeptide comprises at least one embedded or inserted, heterologous T-cell epitope and at least one amino acid is disrupted in an endogenous, B-cell and/or CD4+ T-cell epitope region provided in the Examples (see e.g. Tables 1-7 and/or 12) and wherein the disrupted amino acid does not overlap with the embedded or inserted epitope. Additionally, the Shiga toxin effector polypeptide may be derived from amino acids 75 to 251 of SEQ ID NO:3, 1 to 241 of SEQ ID NO:3, 1 to 251 of SEQ ID NO:3, or amino acids 1 to 261 of SEQ ID NO:3, wherein the Shiga toxin effector polypeptide comprises at least one embedded or inserted, heterologous T-cell epitope and at least one amino acid is disrupted in an endogenous, B-cell and/or CD4+ T-cell epitope region provided in the Examples (see e.g. Tables 1-7 and/or 12) and wherein the disrupted amino acid does not overlap with the embedded or inserted epitope. In certain embodiments of the present invention, the Shiga toxin effector polypeptide comprises an embedded or inserted, heterologous, T-cell epitope and a disrupted furin-cleavage motif at the carboxy-terminus of a Shiga toxin A1 fragment derived region. For example in certain embodiments, the Shiga toxin effector polypeptide of the present invention is derived from amino acids 75 to 251 of SEQ ID NO:1, 1 to 241 of SEQ ID NO:1, 1 to 251 of SEQ ID NO:1, or amino acids 1 to 261 of SEQ ID NO:1, wherein the Shiga toxin effector polypeptide comprises at least one embedded or inserted, heterologous T-cell epitope and a disrupted furin-cleavage motif at the carboxy-terminus of a Shiga toxin A1 fragment derived region. Similarly in other embodiments, the Shiga toxin effector polypeptide of the present invention is derived from amino acids 75 to 251 of SEQ ID NO:2, 1 to 241 of SEQ ID NO:2, 1 to 251 of SEQ ID NO:2, or amino acids 1 to 261 of SEQ ID NO:2, wherein the Shiga toxin effector polypeptide comprises at least one embedded or inserted, heterologous T-cell epitope and a disrupted furin-cleavage motif at the carboxy-terminus of a Shiga toxin A1 fragment derived region. Additionally, the Shiga toxin effector polypeptide may be derived from amino acids 75 to 251 of SEQ ID NO:3, 1 to 241 of SEQ ID NO:3, 1 to 251 of SEQ ID NO:3, or amino acids 1 to 261 of SEQ ID NO:3, wherein the Shiga toxin effector polypeptide comprises at least one embedded or inserted, heterologous T-cell epitope and a disrupted furin-cleavage motif at the carboxy-terminus of a Shiga toxin A1 fragment derived region.

D. Examples of Combination Shiga Toxin Effector Polypeptides

A combination Shiga toxin effector polypeptide of the present invention comprises two or more sub-regions (i.e. non-overlapping sub-regions) wherein each sub-region comprises at least one of the following: (1) a disruption in an endogenous epitope or epitope region; (2) an embedded, heterologous, T-cell epitope-peptide; (3) an inserted, heterologous, T-cell epitope-peptide; and (4) a disrupted furin-cleavage motif at the carboxy-terminus of an A1 fragment derived region.

Certain embodiments of the combination Shiga toxin effector polypeptides of the present invention comprise both (1) a disruption in an endogenous epitope or epitope region and (2) a disrupted furin-cleavage motif at the carboxy-terminus of an A1 fragment derived region. It is predicted that any of the individual, de-immunized, Shiga toxin effector sub-regions described in the Examples below or described in WO 2015/113005 (see e.g. Table B, supra) may generally be combined with any Shiga toxin effector sub-region comprising a disrupted furin-cleavage motif described herein, described in WO 2015/191764, and/or known in the art in order to create a Shiga toxin effector polypeptide of the present invention.

In certain embodiments of the present invention, the Shiga toxin effector polypeptide consists essentially of the polypeptide shown in any one of SEQ ID NOs: 355-438 which further comprises a disruption of at least one, endogenous, B-cell and/or T-cell epitope region which does not overlap with an embedded or inserted, heterologous, CD8+ T-cell epitope; wherein the disruption comprises one or more amino acid residue substitutions relative to a wild-type Shiga toxin. In certain further embodiments the substitution is selected from the group consisting of: K1 to A, G, V, L, I, F, M and H; T4 to A, G, V, L, I, F, M, and S; D6 to A, G, V, L, I, F, S, Q and R; S8 to A, G, V, I, L, F, and M; T9 to A, G, V, I, L, F, M, and S; S9 to A, G, V, L, I, F, and M; K11 to A, G, V, L, I, F, M and H; T12 to A, G, V, I, L, F, M, S, and K; S12 to A, G, V, I, L, F, and M; S33 to A, G, V, L, I, F, M, and C; S43 to A, G, V, L, I, F, and M; G44 to A or L; S45 to A, G, V, L, I, F, and M; T45 to A, G, V, L, I, F, and M; G46 to A and P; D47 to A, G, V, L, I, F, S, M, and Q; N48 to A, G, V, L, M and F; L49 to A, V, C, and G; Y49 to A, G, V, L, I, F, M, and T; F50 to A, G, V, L, I, and T; A51; D53 to A, G, V, L, I, F, S, and Q; V54 to A, G, I, and L; R55 to A, G, V, L, I, F, M, Q, S, K, and H; G56 to A and P; 157 to A, G, V, and M; L57 to A, V, C, G, M, and F; D58 to A, G, V, L, I, F, S, and Q; P59 to A, G, and F; E60 to A, G, V, L, I, F, S, Q, N, D, M, T, and R; E61 to A, G, V, L, I, F, S, Q, N, D, M, and R; G62 to A; R84 to A, G, V, L, I, F, M, Q, S, K, and H; V88 to A and G; I88 to A, V, C, and G; D94 to A, G, V, L, I, F, S, and Q; S96 to A, G, V, I, L, F, and M; T104 to A, G, V, L, I, F, M; and N; A105 to L; T107 to A, G, V, L, I, F, M, and P; S107 to A, G, V, L, I, F, M, and P; L108 to A, V, C, and G; S109 to A, G, V, I, L, F, and M; T109 to A, G, V, I, L, F, M, and S; G110 to A; S112 to A, G, V, L, I, F, and M; D111 to A, G, V, L, I, F, S, Q, and T; S112 to A, G, V, L, I, F, and M; D141 to A, G, V, L, I, F, S, and Q; G147 to A; V154 to A and G. R179 to A, G, V, L, I, F, M, Q, S, K, and H; T180 to A, G, V, L, I, F, M, and S; T181 to A, G, V, L, I, F, M, and S; D183 to A, G, V, L, I, F, S, and Q; D184 to A, G, V, L, I, F, S, and Q; L185 to A, G, V and C; S186 to A, G, V, I, L, F, and M; G187 to A; R188 to A, G, V, L, I, F, M, Q, S, K, and H; S189 to A, G, V, I, L, F, and M; D198 to A, G, V, L, I, F, S, and Q; R204 to A, G, V, L, I, F, M, Q, S, K, and H; R205 to A, G, V, L, I, F, M, Q, S, K and H; S247 to A, G, V, I, L, F, and M; Y247 to A, G, V, L, I, F, and M; R248 to A, G, V, L, I, F, M, Q, S, K, and H; R250 to A, G, V, L, I, F, M, Q, S, K, and H; R251 to A, G, V, L, I, F, M, Q, S, K, and H; D264 to A, G, V, L, I, F, S, and Q; G264 to A; and T286 to A, G, V, L, I, F, M, and S. In certain further embodiments, there are multiple disruptions of multiple, endogenous B-cell and/or CD8+ T-cell epitope regions wherein each disruption involves at least one amino acid residue substitution selected from the group consisting of: K1 to A, G, V, L, I, F, M and H; T4 to A, G, V, L, I, F, M, and S; D6 to A, G, V, L, I, F, S, Q and R; S8 to A, G, V, I, L, F, and M; T9 to A, G, V, I, L, F, M, and S; S9 to A, G, V, L, I, F, and M; K11 to A, G, V, L, I, F, M and H; T12 to A, G, V, I, L, F, M, S, and K; S12 to A, G, V, I, L, F, and M; S33 to A, G, V, L, I, F, M, and C; S43 to A, G, V, L, I, F, and M; G44 to A or L; S45 to A, G, V, L, I, F, and M; T45 to A, G, V, L, I, F, and M; G46 to A and P; D47 to A, G, V, L, I, F, S, M, and Q; N48 to A, G, V, L, M and F; L49 to A, V, C, and G; Y49 to A, G, V, L, I, F, M, and T; F50 to A, G, V, L, I, and T; A51; D53 to A, G, V, L, I, F, S, and Q; V54 to A, G, I, and L; R55 to A, G, V, L, I, F, M, Q, S, K, and H; G56 to A and P; 157 to A, G, V, and M; L57 to A, V, C, G, M, and F; D58 to A, G, V, L, I, F, S, and Q; P59 to A, G, and F; E60 to A, G, V, L, I, F, S, Q, N, D, M, T, and R; E61 to A, G, V, L, I, F, S, Q, N, D, M, and R; G62 to A; R84 to A, G, V, L, I, F, M, Q, S, K, and H; V88 to A and G; 188 to A, V, C, and G; D94 to A, G, V, L, I, F, S, and Q; S96 to A, G, V, I, L, F, and M; T104 to A, G, V, L, I, F, M; and N; A105 to L; T107 to A, G, V, L, I, F, M, and P; S107 to A, G, V, L, I, F, M, and P; L108 to A, V, C, and G; S109 to A, G, V, I, L, F, and M; T109 to A, G, V, I, L, F, M, and S; G110 to A; S112 to A, G, V, L, I, F, and M; D111 to A, G, V, L, I, F, S, Q, and T; S112 to A, G, V, L, I, F, and M; D141 to A, G, V, L, I, F, S, and Q; G147 to A; V154 to A and G. R179 to A, G, V, L, I, F, M, Q, S, K, and H; T180 to A, G, V, L, I, F, M, and S; T181 to A, G, V, L, I, F, M, and S; D183 to A, G, V, L, I, F, S, and Q; D184 to A, G, V, L, I, F, S, and Q; L185 to A, G, V and C; S186 to A, G, V, I, L, F, and M; G187 to A; R188 to A, G, V, L, I, F, M, Q, S, K, and H; S189 to A, G, V, I, L, F, and M; D198 to A, G, V, L, I, F, S, and Q; R204 to A, G, V, L, I, F, M, Q, S, K, and H; R205 to A, G, V, L, I, F, M, Q, S, K and H; S247 to A, G, V, I, L, F, and M; Y247 to A, G, V, L, I, F, and M; R248 to A, G, V, L, I, F, M, Q, S, K, and H; R250 to A, G, V, L, I, F, M, Q, S, K, and H; R251 to A, G, V, L, I, F, M, Q, S, K, and H; D264 to A, G, V, L, I, F, S, and Q; G264 to A; and T286 to A, G, V, L, I, F, M, and S.

Certain embodiments of the Shiga toxin effector polypeptides of the present invention comprise both (1) an embedded or inserted, heterologous, T-cell epitope-peptide and (2) a disrupted furin-cleavage motif at the carboxy-terminus of an A1 fragment derived region. Any of the Shiga toxin effector polypeptide sub-regions comprising an embedded or inserted, heterologous, T-cell epitope described in the Examples below or in WO 2015/113007 may generally be combined with any protease-cleavage resistant, Shiga toxin effector polypeptide sub-region (e.g., modified, Shiga toxin A Subunit sub-regions described herein, described in WO 2015/191764, and/or known in the art) in order to create a combination, Shiga toxin effector polypeptide which, as a component of a cell-targeting molecule, is both protease-cleavage resistant and capable of delivering a heterologous, T-cell epitope to the MHC class I presentation pathway of a target cell. Non-limiting examples of this type of combination Shiga toxin effector polypeptide are shown in SEQ ID NOs: 6-27, 29-32, 340-355, and 370-438.

Certain embodiments of the combination Shiga toxin effector polypeptides of the present invention comprise both (1) a disruption in an endogenous epitope or epitope region and (2) an embedded, heterologous, T-cell epitope-peptide. However, the Shiga toxin effector sub-regions comprising inserted or embedded, heterologous, T-cell epitopes described herein or in WO 2015/191764 are generally not combinable with every de-immunized, Shiga toxin effector sub-regions described herein, except where empirically shown to be successfully combined such that the resulting combination molecule retained a sufficient level of a Shiga toxin effector function(s). The disclosure herein shows how such embodiments may be made and tested to empirically demonstrate success.

The term "successful" is used here to mean two or more amino acid residue substitutions in a Shiga toxin effector polypeptide results in a functional feature, such as, e.g., de-immunization, reduced furin-cleavage, and/or ability to deliver an embedded or inserted epitope, while the modified Shiga toxin effector polypeptide retains one or more Shiga toxin effector functions. The approaches and assays described herein show how to design, make and empirically test embodiments of the present invention, which represent combination, Shiga toxin effector polypeptides and cell-targeting molecules comprising the same.

The combination, Shiga toxin effector polypeptides of the present invention combine the features of their respective sub-regions, such as, e.g., a furin-cleavage motif disruption, individual epitope disruptions, and/or a heterologous T-cell epitope cargo, and these combinations sometimes result in Shiga toxin effector polypeptides with synergistic reductions in immunogenicity as compared to the sum of their partially de-immunized sub-regions. In particular, the exemplary, Shiga toxin effector polypeptides shown in SEQ ID NOs: 13, 16 and 21 are synergistically de-immunized due to the combination of two or more sub-regions, one of which comprises an embedded, heterologous, T-cell epitope and another of which comprises a endogenous epitope disrupted by one or more amino acid residue substitutions.

For certain embodiments, the Shiga toxin effector polypeptide of the present invention comprises or consists essentially of the polypeptide shown in any one of SEQ ID NOs: 6-32, 340-354, and 370-438. For certain embodiments, the combination, de-immunized, protease-cleavage resistant, Shiga toxin effector polypeptides comprising embedded, T-cell epitopes of the present invention comprise or consist essentially of one of the polypeptides represented by SEQ ID NOs: 6-10, 13-32, 340-354, and 370-438.

De-immunized, Shiga toxin effector polypeptides of the present invention which exhibit no cytotoxicity or reduced cytotoxicity at certain concentrations, e.g. Shiga toxin effector polypeptides comprising R179A, may still be useful as de-immunized, Shiga toxin effector polypeptides for delivering exogenous materials into cells. Similarly, CD8+ T-cell hyper-immunized, Shiga toxin effector polypeptides of the present invention which exhibit no cytotoxicity or reduced cytotoxicity at certain concentrations, e.g. a Shiga toxin effector polypeptide comprising an epitope embedded into its catalytic domain (see e.g. WO 2015/113007, Example 1-F), may still be useful for delivering a T-cell epitope(s) to a desired subcellular compartment of a cell in which the Shiga toxin effector polypeptide is present or as a component of a cell-targeting molecule for delivery of a T-cell epitope(s) into a target cell.

E. Examples of Cell-Targeting Molecules of the Present Invention

The Shiga toxin effector polypeptides of the present invention may be used as components of cell-targeting molecules that target various extracellular target biomolecules. The following examples describe in more detail certain structures of exemplary cell-target molecules of the present invention which target cells expressing extracellular target biomolecules such as, e.g., CD19, CD20, CD22, CD30, CD38, CD45, HER2, PD-L1, and TYRP1.

1. Cell-Targeting Molecules Targeting Human CD19

CD19, also recognized in the art as B4, is a 95 kDa, B-lineage specific, type-I transmembrane glycoprotein present on the surface of developing B-cells but not expressed by terminally differentiated plasma cells. While the name CD19 might refer to multiple proteins with related structures and polypeptide sequences from various species, for the purposes of the structural examples of this section, the term "CD19" refers to the B-lymphocyte antigen CD19 proteins present in humans whose exact sequence might vary slightly based on the isoform and from individual to individual. With regard to humans, CD19 refers to the protein represented by the predominant polypeptide sequence UniProt P15391 and (National Center Biotechnology Institute, U.S.) (NCBI) accession AAA69966.1 or AAB60697.1; however, different isoforms and variants exist due to splicing, polymorphisms and/or mutations (see e.g., Kuroki K et al., *Genes Immun* Suppl 1: S21-30 (2002); Tsuchiya N et al., *Arthritis Rheum* 50: 4002-7 (2004); Dawidowicz K et al., *Clin Exp Rheumatol* 29: 839-42 (2011)). A skilled worker will be able to identify other CD19 proteins in humans, even if they differ from the referenced sequences.

CD19 is an attractive target for targeted cancer therapies, e.g., because of the ubiquitous cell-surface expression of CD19 by neoplastic cells and tumors of B-cell lineages. For example, most malignant B-cells were found to express CD19 (see e.g., Anderson K et al., *Blood* 63: 1424 (1984); Uckun F et al., *Blood* 71: 13 (1988); Bradbury L et al., *J Immunol* 149: 2841-50 (1992); Haas K, Tedder T, *Adv Exp Med Biol* 560: 125-39 (2005); Tedder T, *Nat Rev Rheumatol* 5: 572-7 (2009)). Although CD19 is considered a pan B-cell marker expressed throughout B-cell development, mature B-cells and tumor cells of B-cell lineages have been observed to express three-fold more CD19 compared to immature B-cells. In particular, CD19 expression was observed in indolent and aggressive subtypes of non-Hodgkin lymphoma (NHL), B-cell chronic lympocytic leukemia (B-CLL), and forms of acute lymphoblastic leukemia. Furthermore, due to differences in CD19 expression as compared to CD20 expression, CD19-targeted therapies may be able to target B-cell neoplasms at early stages than CD20-targeted therapies.

There are numerous CD19 binding regions known to the skilled worker which may be associated with a Shiga toxin effector polypeptide of the present invention to create a cell-targeting molecule of the present invention. For purposes of the present invention, the term "CD19 binding region" refers to a molecular moiety (e.g. a proteinaceous molecule) or agent capable of specifically binding an extracellular part of a CD19 molecule with high affinity, such as, e.g., having a dissociation constant with regard to CD20 of $10^{-5}$ to $10^{-12}$ moles per liter. As used herein, CD19 binding refers to the ability to bind to an extracellular part of an isoform or variant of human CD19.

In certain embodiments, the CD19 binding region is an immunoglobulin-type binding region. In certain embodiments, the immunoglobulin-type, CD19 binding region is derived from an immunoglobulin, CD19 binding region, such as an antibody paratope capable of binding an extracellular part of CD19. In certain other embodiments, the immunoglobulin-type, CD19 binding region comprises an engineered polypeptide not derived from any immunoglobulin domain but which functions like an immunoglobulin, CD19 binding region by providing high-affinity binding to an extracellular part of CD19. This engineered polypeptide may optionally include polypeptide scaffolds comprising or consisting essentially of complementary determining regions and/or antigen binding regions from immunoglobulins as described herein.

There are numerous CD19 binding regions contemplated as components of the present invention. Non-limiting examples of immunoglobulin-type, CD19 binding regions include CD19-binding monoclonal antibodies and derivatives thereof, such as humanized variants and recombinant immunoglobulin domains, e.g., B4 (e.g. clone eBio1D3), Leu-12 (Leu12), HD37, B43, CLB-CD19, MOPC 21 components, FMC63, MB19-1, cCD19, B4 89B, SJ25-C1, hA19, huB4, hBU12, XmAb5574, MOR208, MEDI-551, SAR3419, AFM11, GBR 401, XmAb 5871, Hm2E8b, B-1, 5F3, 2E2, 1G9, C-20, F-3, HD237, H-300, M-20, R-20, PDR134, BCE19, HIB19, LE-CD19, LT19, CB19, 6D5, 4G7, AB-1, F974A2, J3-119, MDX-1342, MAB7489 (clone 771404), and MAB4867 (clone 4G7-2E3) (see e.g., Caligaris-Cappio F et al., *J Cin Invest* 76: 1243-51 (1985); Chen Z et al., *Leuk Res* 10: 1411-7 (1986); Pezzutto A et al., *J Immunol* 138: 2793-9 (1987); De Rie M et al., *Leuk Res* 12: 135-41 (1988); Uckun F et al., *Blood* 71: 13-29 (1988); Vuist W et al., *Cancer Res* 49: 3783-8 (1989); Carter R et al., *J Immunol* 147: 3663-71 (1991); Zola H et al., *Immunol Cell Biol* 69: 411-22 (1991); Holder M et al., *Eur Jmmunol* 22: 2725-8 (1992); Engel P et al., *Immunity* 3: 39-50 (1995); Pietersz G et al., *Cancer Immunol Immunother* 41: 53-60 (1995); Tisone J et al., *Am J Clin Pathol* 107: 283-91 (1997); WO 2005/012493; Lutz R et al., *Proc Am Assoc Cancer Res* 47: 3731 (2006); Horton H et al., *Cancer Res* 68: 8049-57 (2008); Gerber H et al., *Blood* 113: 4352-61 (2009); Awan F et al., *Blood* 115: 1204-13 (2010); Herbst R et al., *J Pharmacol Exp Ther* 335: 213-22 (2010); Coiffier B et al., *J Clin Oncol* 29: 1182-9 (2011); Reusch U et al., *Blood* 122: 4405 (2013); Breton C et al., *J Hematol Oncol* 7: 33 (2014); Horton H et al., *J Immunol* 186: 4223-33 (2014); Shen D et al., *Monoclon Antib Immunodiagn Immunother* 33: 215-20 (2014)). Non-limiting examples of CD19 binding regions include scFvs, such as, e.g., FVS191, FVS192, scFv-HD37, scFv-FMC63, HD37-C, HD37-CCH, FMC63-28Z, 4G7mut, 4G7-graft (see e.g., Bejeck B et al., *Cancer Res* 55: 2346-51 (1995); Kipriyanov et al., *J ImmunolMeth* 196: 51-62 (1996); Nicholson I et al., *Mol Immunol* 34: 1157-65 (1997); WO 2002/050118; Peipp M et al., *J Immunol Methods* 285: 265-80 (2004); Cheng W et al., *Biochim Biophys Acta* 1768: 21-9 (2007); Kochenderfer J et al., *J Immunother* 32: 689-702 (2009); Kugler M et al., *Protein Eng Des Sel* 22: 135-47 (2009); WO 2012/079000; Kneissi S et al., *PLoS One* 8: e79047 (2013)).

In certain embodiments, the cell-targeting molecule of the present invention comprises a binding region comprising an immunoglobulin-type polypeptide selected for specific and high-affinity binding to human CD19 and/or the cellular surface of a CD19+ cell. In certain embodiments of the cell-targeting molecule of the present invention, the binding region comprises a polypeptide(s) selected from the group consisting of: a) a heavy chain variable ($V_H$) domain comprising (i) a HABR1 comprising or consisting essentially of one of the amino acid sequences as shown in SEQ ID NO:83, SEQ ID NO:89, or SEQ ID NO:96; (ii) a HABR2 comprising or consisting essentially of one of the amino acid sequence as shown in SEQ ID NO:84, SEQ ID NO:90, SEQ ID NO:95, or SEQ ID NO:97; and (iii) a HABR3 comprising or consisting essentially of one of the amino acid sequence as shown in SEQ ID NO:85, SEQ ID NO:91, or SEQ ID NO:98; and b) a light chain variable ($V_L$) domain comprising (i) a LABR1 comprising or consisting essentially of one of the amino acid sequence as shown in SEQ ID NO:86, SEQ ID NO:92, or SEQ ID NO:99; (ii) a LABR2 comprising or consisting essentially of one of the amino acid sequence as shown in SEQ ID NO:97, SEQ ID NO:93, or SEQ ID NO:100; and (iii) a LABR3 comprising or consisting essentially of one of the amino acid sequence as shown in SEQ ID NO:88, SEQ ID NO:94, or SEQ ID NO:101. In certain further embodiments, the cell-targeting molecule of the present invention comprises the binding region comprising or consisting essentially of amino acids 1-232, 1-233, 1-234, 1-235, 1-236, 1-242, 1-243, 1-244, 1-245, 1-246, 1-252, 1-253, 1-254, 1-255, or 1-256 of any one of SEQ ID NOs: 47-119 and 176-248.

According to one specific but non-limiting aspect, the binding region of the cell-targeting molecule of the present invention comprises a ligand (whether naturally occurring or synthetic) or a derivative thereof that retains binding functionality to an extracellular part of CD19. Native CD19 is known to bind at least one ligand, CD19-L, a high mobility group (HMG) box protein (see e.g., Uckun F et al., *Br J Haematol* 153: 15-23 (2011); US 20120141505).

Any of the aforementioned CD19 binding molecules may be suitable for use as a CD19 binding region or modified to create one or more CD19 binding regions for use in a cell-targeting molecule of the present invention.

2. Cell-Targeting Molecules Targeting Human CD20

CD20 (B-lymphocyte antigen CD20) While the name CD20 might refer to multiple proteins with related structures and polypeptide sequences from various species, for the purposes of the structural examples of this section, the term "CD20" refers to the B-lymphocyte antigen CD20 proteins present in humans whose exact sequence might vary slightly based on the isoform and from individual to individual. With regard to humans, CD20 refers to the protein represented by the predominant polypeptide sequence UnitProt P11836 and NCBI accession NP 690605.1; however, different isoforms and variants exist due to splicing, polymorphisms and/or mutations (see e.g., Dawidowicz K et al., *Cin Exp Rheumatol* 29: 839-42 (2011); Fang C et al., *Int J Clin Exp Med* 8: 11235-43 (2015)). A skilled worker will be able to identify other CD20 proteins in humans, even if they differ from the referenced sequences.

CD20 is a cell-surface glycoprotein expressed by normal, B-cell lineage cells within certain cell developmental stages as well as cells of numerous, mature B-cell neoplasms, such as NHL and chronic lymphocytic leukemia (CLL) cells. In addition, CD20 is expressed by mature T-cell and NK-cell neoplasms. CD20 is expressed by a subset of normal T-cells as well as malignant T-cells such as, e.g., in T-cell lymphomas (TCLs) including mycosis fungoides (MF), natural killer cell lymphoma (NK-cell lymphoma), peripheral T-cell lymphomas (PTCLs), cutaneous T-cell lymphomas, and T-cell large granular lymphocyte leukemia (T-LGLL). The association of cell-surface CD20 with malignant cells makes it an attractive target for cell-targeted therapies.

There are numerous CD20 binding regions known to the skilled worker which may be associated with a Shiga toxin effector polypeptide of the present invention to create a cell-targeting molecule of the present invention. For purposes of the present invention, the term "CD20 binding region" refers to a molecular moiety (e.g. a proteinaceous molecule) or agent capable of specifically binding an extracellular part of a CD20 molecule with high affinity, such as, e.g., having a dissociation constant with regard to CD20 of $10^{-5}$ to $10^{-12}$ moles per liter. As used herein, CD20 binding refers to the ability to bind to an extracellular part of an isoform or variant of human CD20.

In certain embodiments, the CD20 binding region is an immunoglobulin-type binding region. In certain embodiments, the immunoglobulin-type, CD20 binding region is derived from an immunoglobulin, CD20 binding region, such as an antibody paratope capable of binding an extracellular part of CD20. In certain other embodiments, the immunoglobulin-type, CD20 binding region comprises an engineered polypeptide not derived from any immunoglobulin domain but which functions like an immunoglobulin, CD20 binding region by providing high-affinity binding to an extracellular part of CD20. This engineered polypeptide may optionally include polypeptide scaffolds comprising or consisting essentially of complementary determining regions and/or antigen binding regions from immunoglobulins as described herein.

There are numerous CD20 binding regions contemplated as components of the present invention, such as, e.g. CD20 binding regions described in PCT/US2016/016580. Non-limiting examples of immunoglobulin-type, CD20 binding regions include monoclonal antibodies and derivatives (e.g., humanized variants and scFvs) such as, e.g., 1F5, 1H4, 1K1791, 2B8, Leu16, Leu6, 2F2, 2H7, 7D8, 8E4, 11B8, AME-133v, LY2469298, B9E9, BM-ca, C2B8, CKI, GA101, R05072759, LT20, ibritumomab, HB20-1-25, MB20-1-18, obinutuzumab, ocaratuzumab, ocrelizumab, PR070769, ofatumumab, OUBM1-OUBM8, PRO131921, rituximab, TGLA, tositumomab, TRU-015, ublituximab, veltuzumab, IMMU-106, hA20, the CD20-binding fibronectin domain FN3CD20, and HL23-scFvs: scFv-1, scFv-3, scFv-5, and scFv-8 (see e.g. Golay J et al., *J Immunol* 135: 3795-801 (1985); Tedder T et al., *Eur J Immunol* 16: 881-7 (1986); Liu A et al., *Proc Natl Acad Sci USA* 84: 3439-43 (1987); Press O et al., *Blood* 69: 584-91 (1987); Maloney D et al., *Blood* 84: 2457-66 (1994); Reff M et al., *Blood* 83: 435-45 (1994); Hooijberg E et al., *Cancer Res* 55: 840-6 (1995); Hooijberg E et al., *Hybridoma* 15: 23-31 (1996); Anderson D et al., *Biochem Soc Trans* 25: 705-8 (1997); Haisma H et al., *Blood* 92: 184-90 (1998); Wiseman G et al., *Clin Cancer Res* 5: 3281s-3286s (1999); Schultz J et al., *Cancer Res* 60: 6663-9 (2000); Cardarelli P et al., *Cancer Immunol Immunother* 51: 15-24 (2002); Cheson B, *Curr Opin Investig Drugs* 3: 165-70 (2002); Polyak M et al., *Blood* 99: 3256-62 (2002); Teeling J et al., *Blood* 104: 1793-800 (2004); Geng S et al., *Cell Mol Immunol* 3: 439-43 (2006); de Boer O et al., *PLoS One* 2: e779 (2007); Burge D et al., *Clin Ther* 30: 1806-16 (2008); Hagenbeek A et al., *Blood* 111: 5486-95 (2008); Nishida M et al., *Intl J Oncol* 32: 1263-74 (2008); Morschhauser F et al., *J Clin Oncol* 27: 3346-53 (2009); Lim S et al., *Haematologica* 95: 135-43 (2010); Lv M et al., *Cancer Lett* 294: 66-73 (2010); Morschhauser F et al., *Ann Oncol* 21: 1870-6 (2010); Mossner E et al., *Blood* 115: 4393-402 (2010); Olafesn T et al., *Protein Eng Des Sel* 23: 243-9 (2010); Uchiyama S et al., *Cancer Sci* 101: 201-9 (2010); Wu L et al., *Cancer Lett* 292: 208-14 (2010); Alduaij W et al., *Blood* 117: 4519-29 (2011); Boross P et al., *Haematologica* 96: 1822-30 (2011); Fang H et al., *Sci China Life Sci* 54: 255-62 (2011); Nickerson-Nutter C et al., *Rheumatology* 50: 1033-44 (2011); Robak T, Robak E, *BioDrugs* 25: 13-25 (2011); Cang S et al., *J Hematol Oncol* 5: 64 (2012); Salles G et al., *Blood* 119: 5126-32 (2012); Abdelwahed R et al., *Invest Ophthalmol Vis Sci* 54: 3657-65 (2013); Golay J et al., *Blood* 122: 3482-91 (2013); Kinder M et al., *J Biol Chem* 288: 3084-54 (2013); Kobayashi H et al., *Cancer Med* 2: 130-43 (2013); Natarajan A et al., *Clin Cancer Res* 19: 6820-9 (2013); Zhang H et al., *Cell Physiol Biochem* 32: 645-54 (2013); Ahmadzadeh V et al., *Protein Expr Purif* 102: 45-41 (2014); Ellbrecht C et al., *JAMA Dermatol* 1939 (2014); Garff-Tavernier M et al., *Leukemia* 28: 230-3 (2014); U.S. Pat. Nos. 4,861,579; 5,500,362; 5,595,721; 5,677,180; 5,721,108; 5,736,137; 5,776,456; 5,843,398; 5,849,898; 6,015,542; 6,090,365; 6,120,767; 6,171,586; 6,194,551; 6,224,866; 6,242,195; 6,287,537; 6,306,393; 6,368,596; 6,399,061; 6,410,391; 6,455,043; 6,528,624; 6,538,124; 6,565,827; 6,652,852; 6,682,734; 7,879,984; 8,101,179; 8,153,125; 8,337,844; and patent application publications WO 1995/03770; WO 1998/58964; WO 1999/22764; WO 2000/09160; WO 2000/27428; WO 2000/27433; WO 2000/42072; WO 2000/44788; WO 2000/67795; WO 2000/67796; WO 2000/76542; WO 2001/03734; WO 2001/10460; WO 2001/10461; WO 2001/10462; WO 2001/13945; WO 2001/72333; WO 2001/80884; WO 2001/97858; WO 2002/060955; WO 2002/079255; WO 2002/096948; WO 2002/102312; WO 2003/002607; WO 2003/061694; WO 2004/032828; WO 2005/000901; WO 2005016969; WO 2006/106959; WO 2009/031230; WO 2014/076292; US 2011/0091483; U.S. Ser. No. 12/094,583; PCT/US2010/055826; EP20140151932; PCT/GB2012/052532; U.S. Ser. No. 13/048,135; EP20140151932; PCT/GB2012/052532; U.S. Ser. No. 13/048,135; PCT/US2006/046034).

In certain embodiments, the cell-targeting molecule of the present invention comprises a binding region comprising an immunoglobulin-type polypeptide selected for specific and high-affinity binding to human CD20 and/or the cellular surface of a CD20+ cell. In certain embodiments of the cell-targeting molecule of the present invention, the binding region comprises a polypeptide(s) selected from the group consisting of: a) a heavy chain variable ($V_H$) domain comprising (i) a HCDR1 comprising or consisting essentially of one of the amino acid sequences as shown in SEQ ID NO:102, SEQ ID NO:108, SEQ ID NO:114, SEQ ID NO:120, or SEQ ID NO:124; (ii) a HCDR2 comprising or consisting essentially of one of the amino acid sequence as shown in SEQ ID NO:103, SEQ ID NO:115, or SEQ ID NO:125; and (iii) a HCDR3 comprising or consisting essentially of one of the amino acid sequence as shown in SEQ ID NO:104, SEQ ID NO:109, SEQ ID NO:111, SEQ ID NO:116, SEQ ID NO:121, or SEQ ID NO:126; and b) a light chain variable ($V_L$) domain comprising (i) a LCDR1 comprising or consisting essentially of one of the amino acid sequence as shown in SEQ ID NO:105, SEQ ID NO:110, SEQ ID NO:112, SEQ ID NO:117, or SEQ ID NO:127; (ii) a LCDR2 comprising or consisting essentially of one of the amino acid sequence as shown in SEQ ID NO:106, SEQ ID NO:118, SEQ ID NO:122, or SEQ ID NO:128; and (iii) a LCDR3 comprising or consisting essentially of one of the amino acid sequence as shown SEQ ID NO:107, SEQ ID NO:113, SEQ ID NO:119, SEQ ID NO:123, or SEQ ID NO:129. In certain further embodiments, the binding region comprises or consists essentially of amino acids 1-245 of any one of SEQ ID NOs: 33, 64, and 65.

Any of the aforementioned CD20 binding molecules may be suitable for use as a CD20 binding region or modified to create one or more CD20 binding regions for use in a cell-targeting molecule of the present invention.

3. Cell-Targeting Molecules Targeting Human CD22

CD22, also recognized in the art as Siglec-2, SIGLEC2, BL-CAM, B3, Leu-14, and Lyb-8, is a transmembrane glycoprotein of about 120-140 kDa (depending on the spliceoform) that binds sialic acid ligands. CD22 is expressed specifically by B-cells during development and by a specific subset of mature B-cells. While the name CD22 might refer to multiple proteins with related structures and polypeptide sequences from various species, for the purposes of the structural examples of this section, the term "CD22" refers to sialic acid-binding lectin proteins present in humans whose exact sequence might vary slightly based on the isoform and from individual to individual. With regard to humans, CD22 refers to the protein represented by the predominant polypeptide sequence UniProt P20273 and NCBI accession NP_001265346.1; however, different isoforms and variants exist due to splicing, polymorphisms and/or mutations (see e.g., Hitomi Y et al., *Tissue Antigens* 69: 242-9 (2007); Dawidowicz K et al., *Clin Exp Rheumatol* 29: 839-42 (2011)). A skilled worker will be able to identify other CD22 proteins in humans, even if they differ from the referenced sequences.

As B-cell specific marker, CD22 is an attractive target for cell-targeted therapies for diseases and conditions involving B-cells, such as, e.g., conditions involving overactive B-cells, elevated B-cell populations, B-cell mediated autoimmune diseases, leukemias, and lymphomas (see e.g. Nitschke L, *Glycobiology* 24: 807-17 (2014)). In addition, CD22 might be overexpressed by a variety of malignant B-cells, such as, e.g., B-cell neoplasms for which the majority that have been analyzed expressed cell-surface CD22.

There are numerous CD22 binding regions known to the skilled worker which may be associated with a Shiga toxin effector polypeptide of the present invention to create a cell-targeting molecule of the present invention. For purposes of the present invention, the term "CD22 binding region" refers to a molecular moiety (e.g. a proteinaceous molecule) or agent capable of specifically binding an extracellular part of a CD22 molecule with high affinity, such as, e.g., having a dissociation constant with regard to CD22 of $10^{-5}$ to $10^{-12}$ moles per liter. As used herein, CD2 binding refers to the ability to bind to an extracellular part of an isoform or variant of human CD22.

In certain embodiments, the CD22 binding region is an immunoglobulin-type binding region. In certain embodiments, the immunoglobulin-type, CD22 binding region is derived from an immunoglobulin, CD22 binding region, such as an antibody paratope capable of binding an extracellular part of CD22. In certain other embodiments, the immunoglobulin-type, CD22 binding region comprises an engineered polypeptide not derived from any immunoglobulin domain but which functions like an immunoglobulin, CD22 binding region by providing high-affinity binding to an extracellular part of CD22. This engineered polypeptide may optionally include polypeptide scaffolds comprising or consisting essentially of complementary determining regions and/or antigen binding regions from immunoglobulins as described herein.

There are numerous CD22 binding regions contemplated as components of the present invention. Non-limiting examples of immunoglobulin-type, CD22 binding regions include CD22-binding monoclonal antibodies and derivatives thereof, such as humanized variants and recombinant immunoglobulin domains, e.g., RFB4, alpha S-HCL-1 (alpha Leu-14), HD39, To15, 4KB128, HD37, EPB, HD6, LL2, HA22-LR, 11B22.7, Hu10F4 (MCDT2219A or pinatuzumab), epratuzumab, inotuzumab, CAT-3888 (BL22), CAT-8015 (moxetumomab), and scFv-4KB128 (see e.g., Campana D et al., *J Immunol* 134: 1524-30 (1985); Schwarting R et al., *Blood* 65: 974-83 (1985); Dorken B et al., *J Immunol* 136: 4470-9 (1986); Mason D et al., *Blood* 69: 836-40 (1987); Ghetie M et al., *Cancer Res* 48: 2610-7 (1988); Pawlak-Byczkowska E et al., *Cancer Res* 49: 4568-77 (1989); Press O et al., *Cancer Res* 49: 4906-12 (1989); Stein R et al., *Cancer Immunol Immunother* 37: 293-8 (1993); Leung S et al., *Hybridoma* 13: 469-76 (1994); WO 1994/027638; Leung S et al., *Mol Immunol* 32: 1413-27 (1995); WO 1998/041641; WO 2000/074718; Coleman M et al., *Clin Cancer Res* 9: 3991S-4S (2003); WO 2003/027135; WO 2003/072036; Arndt M et al., *FEBS Lett* 578: 257-61 (2004); Furman et al., *Curr Treat Options Oncol* 5: 283-8 (2004); WO 2005/012493; Ho M et al., *Proc Natl Acad Sci USA* 103: 9637-42 (2006); U.S. Pat. No. 7,074,403; WO 2008/070569; O'Donnell et al., *Caner Immunol Immunother* 58: 1715-22 (2009); Mussai Et al., *Br J Haematol* 150: 352-8 (2010); Polson A et al., *Leukemia* 24: 1566-73 (2010); Wayne et al., *Cin Cancer Res* 16: 1894-903 (2010); Wong et al., *Expert Opin Biol Ther* 10: 1251-8 (2010); US 20140248278; JP201518404).

In certain embodiments, the cell-targeting molecule of the present invention comprises a binding region comprising an immunoglobulin-type polypeptide selected for specific and high-affinity binding to human CD22 and/or the cellular surface of a CD22+ cell. In certain embodiments of the cell-targeting molecule of the present invention, the binding region comprises a polypeptide(s) selected from the group consisting of: a) a heavy chain variable ($V_H$) domain comprising (i) a HABR1 comprising or consisting essentially of one of the amino acid sequences as shown in SEQ ID NO:130, SEQ ID NO:136, SEQ ID NO:142, or SEQ ID NO:148; (ii) a HABR2 comprising or consisting essentially of one of the amino acid sequence as shown in SEQ ID NO:131, SEQ ID NO:137, SEQ ID NO:143, or SEQ ID NO:149; and (iii) a HABR3 comprising or consisting essentially of one of the amino acid sequence as shown in SEQ ID NO:132, SEQ ID NO:138, SEQ ID NO:144 or SEQ ID NO:150; and b) a light chain variable ($V_L$) domain comprising (i) a LABR1 comprising or consisting essentially of one of the amino acid sequence as shown in SEQ ID NO:133, SEQ ID NO:139, SEQ ID NO:145, or SEQ ID NO:151; (ii) a LABR2 comprising or consisting essentially of one of the amino acid sequence as shown in SEQ ID NO:134, SEQ ID NO:140, SEQ ID NO:146, or SEQ ID NO:152; and (iii) a LABR3 comprising or consisting essentially of one of the amino acid sequence as shown in SEQ ID NO:135, SEQ ID NO:141, SEQ ID NO:147, or SEQ ID NO:153. Alternatively, the binding regions could be described by CDRs, which largely overlap with ABRs and are described in SEQ ID NOs: 154-165. In certain further embodiments, the binding region comprises or consists essentially of amino acids 269-513 of SEQ ID NO: 40 or 80.

According to one specific but non-limiting aspect, the binding region of the cell-targeting molecule of the present invention comprises a ligand (whether naturally occurring or synesthetic) or derivative thereof that retains binding functionality to CD22, such as, e.g., sialic acids, sialic acid-containing glycoconjugates, and domains of soluble type-M immunoglobulins (IgMs) (see e.g. Bakker T et al., *Eur J Immunol* 32: 1924-32 (2002); Chen W et al., *Blood* 115: 4778-86 (2010); Chen W et al., *Leuk Lymphoma* 53: 208-10 (2012); Schweizer A et al., *Eur J Immunol* 42: 2792-802 (2012)). Synthetic CD22 ligands with high binding affinities have been designed and can be used for cell-targeting (see e.g., Razi N, Varki A et al., *Proc Natl Acad Sci USA* 95: 7469-74 (1998); Sliedregt L et al., *Bioorg Med Chem* 9: 85-97 (2001); van Rossenberg S et al., *J Biol Chem* 276: 12967-73 (2001); Kelm S et al., *J Exp Med* 195: 1207-13 (2002); Collins B et al., *J Immunol* 177: 2994-3003 (2006); Yu J et al., *Biochem Biophys Res Commun* 360: 759-64 (2007); Abdu-Allah H et al., *J Med Chem* 51: 6665-81

(2008); O'Reilly M et al., *JAm Chem Soc* 130: 7736-45 (2008); Abdu-Allah H et al., *Bioorg Med Chem Lett* 19: 5573-5 (2009); Chen W et al., *Blood* 115: 4778-86 (2010); Lepenies B et al., *Curr Opin Chem Biol* 14: 404-11 (2010); Abdu-Allah H et al., *Bioorg Med Chem* 19: 1966-71 (2011); Chen W et al., *Leuk Lymphoma* 53: 208-10 (2012); Mesch S et al., *Chem Med Chem* 7: 134-43 (2012); Kelm S et al., *Angew Chem Int Ed Engl* 52: 3616-20 (2013); Macauley M et al., *J Clin Invest* 123: 3074-83 (2013); Preshcer H et al., *ACS Chem Biol* 9: 1444-50 (2014)).

Any of the aforementioned CD22 binding molecules may be suitable for use as a CD22 binding region or modified to create one or more CD22 binding regions for use in a cell-targeting molecule of the present invention.

4. Cell-Targeting Molecules Targeting Human CD30

CD30, also recognized in the art as tumor necrosis factor receptor superfamily 8 (TNFRSF8) or Ki-1/120, is a type I transmembrane glycoprotein of a size of about 90 to 120 kDa. CD30 functions as a cell-surface receptor (or co-receptor) of the tumor necrosis factor receptor family and binds a ligand, CD30L. A CD30 antigen was first described as a marker of classical Hodgkin lymphoma and Reed-Sternberg cells present in patients with Hodgkin's disease (Schwab U et al., *Nature* 299: 65-7 (1982); Stein H et al., *Int J Cancer* 30: 445-459 (1982)), and CD30 antigen was later observed on non-Hodgkin lymphoma cells (see e.g. Stein H et al., *Blood* 66: 848-58 (1985)). While the name CD30 might refer to multiple proteins with related structures and polypeptide sequences from various species, for the purposes of the structural examples of this section, the term "CD30" refers to the tumor necrosis factor receptor proteins present in humans whose exact sequence might vary slightly based on the isoform and from individual to individual. With regard to humans, CD30 refers to the protein represented by the predominant polypeptide sequence UniProt P28908 and NCBI accession AAA51947.1; however, different isoforms and variants may exist due to splicing, polymorphisms and/or mutations. A skilled worker will be able to identify other CD30 proteins in humans, even if they differ from the referenced sequences.

CD30 is an attractive target for cell-targeted therapeutics, e.g., because its expression is largely restricted to activated and/or proliferating lymphocytes and malignant cells. In normal or inflamed tissues, CD30 expression is largely restricted to medium/large activated B-cells and/or activated T-cells which produce Th2-type cytokines (Chiarle R et al., *Cin Immunol* 90: 157-64 (1990); Werner B et al., *J Cutan Pathol* 35: 1100-7 (2008); Buchan S, Al-Shamkhani A, *PLoS One* 7: e45244 (2012)). CD30 is highly expressed by certain cell types, such as, e.g., certain lymphoma cells, other malignant lymphoid cells, and non-lymphoid tumor cells, whereas only a restricted subset of healthy cells express CD30 and at lower levels (Deutsch Y et al., *LeukLymphoma* 52: 1641-54 (2011)). CD30 is expressed by cells involved in lymphoproliferative disorders, lymphoid neoplasms, and myeloid neoplasms. For example, CD30 is expressed on a subset of non-Hodgkin lymphoma cells, including Burkitt's, anaplastic large-cell lymphoma cells (ALCL), T-cell lymphomas, cutaneous T-cell lymphoma cells, nodular small cleaved-cell lymphoma cells, lymphocytic lymphoma cells, peripheral T-cell lymphoma cells, Lennert's lymphoma cells, immunoblastic lymphoma cells, T-cell leukemidymphoma cells (ATLL), adult T-cell leukemia (T-ALL), centroblastic/centrocytic (cb/cc) follicular lymphoma cells, and lymphomatoid papulosis cells (see e.g., Stein H et al., *Blood* 66: 848-58 (1985); Stein et al., *Neoplastic Hematophathology*, pg 675, (Baltimore, Williams & Wilkins, Knowles D, ed.) (1985); Stein H et al., *Pathology of Cells Receptors and Tumor Markers*, pg 121 (Stuttgart, Gustav Fischer Verlag, Sefert G, Hubner K (eds) (1987); Suchi T et al., *J Clin Pathol* 40: 995 (1987); Eckert F et al., *Am J Dermatopathol* 11: 345-52 (1989); Moller Petal., *Am J Clin Pathol* 91: 18-23 (1989); Burns B, Dardick I, *Am J Clin Pathol* 93: 327-32 (1990); Piris Metal., Histopathology 17: 211-8 (1990); Miettinen M, *Arch Pathol Lab Med* 116: 1197-201 (1992); Norduyn L et al., *J Clin Pathol* 47: 33-7 (1994); Sabattini E et al., *Haematologica* 98: e8 1-2 (2013)). CD30 expression has been observed in embryonal carcinomas, nonembryonal carcinomas, malignant melanomas, mesenchymal tumors, and myeloid cell lines and macrophages at late stages of differentiation (see e.g., Andreesen R et al., *Blood* 63: 1299-1302 (1984); Schaadt M et al., *Int Rev Exp Pathol* 27: 185-202 (1985); Stein H et al., *Haematol Blood Transfus* 29: 441-4 (1985); Froese P et al., *J Immunol* 139: 2081-7 (1987); Pallesen G, Hamilton-Dutoit S, *Am J Pathol* 133: 446-50 (1988); Andreesen R et al., *Am J Pathol* 134: 187-92 (1989); Hansen H et al., *Biol Chem Hoppe-Seyler* 370: 409-16 (1989); Schwarting R et al., *Blood* 74: 1678-89 (1989); Mechtersheimer G, Möller P, *Cancer* 66: 1732-7 (1990); Pallesen G, *Histopathology* 16: 409-13 (1990); Dürkop H et al., *Cell* 68: 421-7 (1992); Latza U et al., *Am J Pathol* 146: 463-71 (1995)). CD30 expression appears upregulated by neoplastic mast cells of advanced neoplasms, such as, neoplasms involved in mastocytosis and systemic mastocytosis (see e.g., Soltar K et al., *Mod Pathol* 24: 585-95 (2011); Valent P et al., *Leuk Lymphoma* 52: 740-4 (2011)). CD30 expression also has been reported to increase in a variety of autoimmune and inflammatory diseases, such as, e.g., lymphoid neoplasms, myeloid neoplasms, atopic allergies (atopic dermatitis, atopic asthma, rhinoconjunctivitis, allergic rhinitis), systemic lupus erythematosus, systemic sclerosis (scleroderma), graft-versus-host disease, HIV infection, Epstein-Barr virus infection, measles, mononucleosis infection, Omen's syndrome, ulcerative colitis, rheumatoid arthritis, multiple sclerosis, psoriasis, Hashimoto's thyroiditis, primary biliary cirrhosis, Sjögren's syndrome, toxoplasmosis, Wegener's granulomatosis, and tuberculosis (see e.g., Ralfkiaer E et al., *Arch Dermatol Res* 279: 28-292 (1987); Romagnani S et al., *J Leukocyte Biol* 57: 726-30 (1995); Gruss H et al., *Immunol Today* 18: 156-63 (1997); Horie R, Watababe T, *Semin Immunol* 10: 457-70 (1998); Bengtsson A, *Allergy* 561: 593-603 (2001); Gerli R et al., *Trends Immunol* 22: 72-7 (2001)). CD30 expression is a marker for mastocytosis (see e.g. Maric J, Calvo K, *Leuk Lymphoma* 52: 732-3 (2011)).

There are numerous CD30 binding regions known to the skilled worker which may be associated with a Shiga toxin effector polypeptide of the present invention to create a cell-targeting molecule of the present invention. For purposes of the present invention, the term "CD30 binding region" refers to a molecular moiety (e.g. a proteinaceous molecule) or agent capable of specifically binding an extracellular part of a CD30 molecule with high affinity, such as, e.g., having a dissociation constant with regard to CD30 of $10^{-5}$ to $10^{-12}$ moles per liter. As used herein, CD30 binding refers to the ability to bind to an extracellular part of an isoform or variant of human CD30.

In certain embodiments, the CD30 binding region is an immunoglobulin-type binding region. In certain embodiments, the immunoglobulin-type, CD30 binding region is derived from an immunoglobulin, CD30 binding region, such as an antibody paratope capable of binding an extracellular part of CD30. In certain other embodiments, the immunoglobulin-type, CD30 binding region comprises an engineered polypeptide not derived from any immunoglobulin domain but which functions like an immunoglobulin, CD30 binding region by providing high-affinity binding to an extracellular part of CD30. This engineered polypeptide may optionally include polypeptide scaffolds comprising or consisting essentially of complementary determining regions and/or antigen binding regions from immunoglobulins as described herein.

There are numerous CD30 binding regions contemplated as components of the present invention. Non-limiting examples of immunoglobulin-type, CD30 binding regions include CD30-binding monoclonal antibodies and derivatives thereof, such as humanized variants and recombinant immunoglobulin domains, e.g., Ki-1, HeFi-1, Ber-H2, Ber-H4, Ber-H6, Ber-H8, Ber-H10, HRS-1, HRS-3, HRS-4, AC10, C10, Ki-2, Ki-3, Ki-4, Ki-5, Ki-6, Ki-7, M44, M67, scFv-Ki-4, scFv 4E3, T6, T7, T13, T14, T21, T24, T25, T104, T105, T107, T112, T201, T214, T215, T405, T406, T408, T411, T420, T426, T427 (see e.g., Schwab U et al., *Nature* 299: 65-7 (1982); Hecht T et al., *J Immunol* 134: 4231-6 (1985); Schwarting R et al., Issue Sections. In: *J. A.* McMichael (ed.). Leucocyte Typing 3: 574-75. Oxford: Oxford University Press, (1987); Schwarting R et al., Leucocyte Typing IV: 419-22. Oxford, UK, Oxford University (1989); Bowen M et al., *J Immunol* 151: 5896-906 (1993); Gruss H et al., *Blood* 83: 2045-56 (1994); Horn-Lohrens O et al., *Int J Cancer* 60: 539-44 (1995); WO 1996/022384; Barth S et al., *Blood* 95: 3909-14 (2000); Klimka A et al., *Br J Cancer* 83: 252-60 (2000); WO 2002/043661; WO 2003/059282; US 2004/018194; WO 2005/001038; WO 2007/040653; WO 2008/025020; WO 2015/028444).

In certain embodiments, the cell-targeting molecule of the present invention comprises a binding region comprising an immunoglobulin-type polypeptide selected for specific and high-affinity binding to human CD30 and/or the cellular surface of a CD30+ cell. In certain embodiments of the cell-targeting molecule of the present invention, the binding region comprises a polypeptide(s) selected from the group consisting of: a) a heavy chain variable ($V_H$) domain comprising (i) a HABR1 comprising or consisting essentially of one of the amino acid sequences as shown in SEQ ID NO:166, SEQ ID NO:172, SEQ ID NO:178, or SEQ ID NO:184; (ii) a HABR2 comprising or consisting essentially of one of the amino acid sequence as shown in SEQ ID NO:167, SEQ ID NO:173, SEQ ID NO:179, or SEQ ID NO:185; and (iii) a HABR3 comprising or consisting essentially of one of the amino acid sequence as shown in SEQ ID NO:168, SEQ ID NO:174, or SEQ ID NO:180; and b) a light chain variable ($V_L$) domain comprising (i) a LABR1 comprising or consisting essentially of one of the amino acid sequence as shown in SEQ ID NO:169, SEQ ID NO:175, SEQ ID NO:181 or SEQ ID NO:186; (ii) a LABR2 comprising or consisting essentially of one of the amino acid sequence as shown in SEQ ID NO:170, SEQ ID NO:176, SEQ ID NO:182, or SEQ ID NO:187; and (iii) a LABR3 comprising or consisting essentially of one of the amino acid sequence as shown in SEQ ID NO:171, SEQ ID NO:177, SEQ ID NO:183, or SEQ ID NO:188. In certain further embodiments, the cell-targeting molecule of the present invention comprises the binding region comprising or consisting essentially of amino acids 268-500 of any one of SEQ ID NOs: 452, 472, 487, and 503.

According to one specific but non-limiting aspect, the binding region of the cell-targeting molecule of the present invention comprises a ligand (whether naturally occurring or synthetic) or a derivative thereof that retains binding functionality to an extracellular part of CD30 (see e.g. Powell I et al., *J Leukoc Biol* 63: 752-7 (1998); Gruss H et al., *Eur J Immunol* 25: 2083 (1995); Gattei V et al., *Leuk Lymphoma* 35: 21-35 (1999); Zhang P et al., *Lab Invest* 89: 1423-32 (2009); Parekh P et al., *Biomaterials* 34: 8909-17 (2013); Shinoda K et al., *J Autoimmun* 57: 14-23 (2015); WO 1993/024135).

Any of the aforementioned CD30 binding molecules may be suitable for use as a CD30 binding region or modified to create one or more CD30 binding regions for use in a cell-targeting molecule of the present invention.

5. Cell-Targeting Molecules Targeting Human CD38

CD38 is transmembrane protein characterized as both a cell surface receptor and extracellular cyclic ADP ribose hydrolase (ADP-ribosylase). While the name CD38 might refer to multiple proteins with related structures and polypeptide sequences from various species, for the purposes of the structural examples of this section, the term "CD38" refers to the cyclic ADP ribose hydrolase proteins present in humans whose exact sequence might vary slightly based on the isoform and from individual to individual. With regard to humans CD38 refers to the protein represented by the predominant polypeptide sequence UniProt P28907 and NCBI accession BAA18964; however, different isoforms and variants may exist due to splicing, polymorphisms and/or mutations (see e.g. Ferrero E et al., *Immunogenetics* 49: 597-604 (1999); Gonzalez-Escribano M et al., *Hum Immunol* 65: 660-664 (2004); Drummond F et al., *J Bone Miner Metab* 24: 28-35 (2006); Aydin S et al., *Blood* 111: 5646-53 (2008); WO 2006/099875). A skilled worker will be able to identify other CD38 proteins in humans, even if they differ from the referenced sequences.

There are numerous CD38 binding regions known to the skilled worker which may be associated with a Shiga toxin effector polypeptide of the present invention to create a cell-targeting molecule of the present invention. For purposes of the present invention, the term "CD38 binding region" refers to a molecular moiety (e.g. a proteinaceous molecule) or agent capable of specifically binding an extracellular part of a CD38 molecule with high affinity, such as, e.g., having a dissociation constant with regard to CD38 of $10^{-5}$ to $10^{-12}$ moles per liter. As used herein, CD38 binding refers to the ability to bind to an extracellular part of an isoform or variant of human CD38.

In certain embodiments, the CD38 binding region is an immunoglobulin-type binding region. In certain embodiments, the immunoglobulin-type, CD38 binding region is derived from an immunoglobulin, CD38 binding region, such as an antibody paratope capable of binding an extracellular part of CD38. In certain other embodiments, the immunoglobulin-type, CD38 binding region comprises an engineered polypeptide not derived from any immunoglobulin domain but which functions like an immunoglobulin, CD38 binding region by providing high-affinity binding to an extracellular part of CD38. This engineered polypeptide may optionally include polypeptide scaffolds comprising or consisting essentially of complementary determining regions and/or antigen binding regions from immunoglobulins as described herein.

There are numerous CD38 binding regions contemplated as components of the present invention. Non-limiting examples of immunoglobulin-type, CD38 binding regions include CD38-binding monoclonal antibodies and scFvs such as, e.g daratumumab, isatuximab, and MOR202 (see e.g. Deaglio S et al., *Trends Mol Med* 14: 210-8 (2008); van de Donk N et al., *Immunol Rev* 270: 95-112 (2016); WO 1996/016990; WO 2002/006347; WO 2005/103083; WO 2008/047242; WO 2012/092612; WO 2012/092616; US20020164788; US20100285004; US 20150118251).

In certain embodiments, the cell-targeting molecule of the present invention comprises a binding region comprising an immunoglobulin-type polypeptide selected for specific and high-affinity binding to human CD38 and/or the cellular surface of a CD38+ cell. In certain embodiments of the cell-targeting molecule of the present invention, the binding region comprises a polypeptide(s) selected from the group consisting of: a) a heavy chain variable ($V_H$) domain comprising (i) a HABR1 comprising or consisting essentially of one of the amino acid sequences as shown in SEQ ID NO:189, SEQ ID NO:195, SEQ ID NO:201, SEQ ID NO:207, SEQ ID NO:213, or SEQ ID NO:219; (ii) a HABR2 comprising or consisting essentially of one of the amino acid sequence as shown in SEQ ID NO:190, SEQ ID NO:196, SEQ ID NO:202, SEQ ID NO:208, SEQ ID NO:214, or SEQ ID NO:220; and (iii) a HABR3 comprising or consisting essentially of one of the amino acid sequence as shown in SEQ ID NO:191, SEQ ID NO:197, SEQ ID NO:203, SEQ ID NO:209, SEQ ID NO:215, or SEQ ID NO:221; and b) a light chain variable ($V_L$) domain comprising (i) a LABR1 comprising or consisting essentially of one of the amino acid sequence as shown in SEQ ID NO:192, SEQ ID NO:198, SEQ ID NO:204, SEQ ID NO:210, SEQ ID NO:216, or SEQ ID NO:222; (ii) a LABR2 comprising or consisting essentially of one of the amino acid sequence as shown in SEQ ID NO:193, SEQ ID NO:199, SEQ ID NO:205, SEQ ID NO:211, SEQ ID NO:217, or SEQ ID NO:223; and (iii) a LABR3 comprising or consisting essentially of one of the amino acid sequence as shown in SEQ ID NO:194, SEQ ID NO:200, SEQ ID NO:206, SEQ ID NO:212, SEQ ID NO:218, or SEQ ID NO:224. Alternatively, the binding regions could be described by CDRs, which largely overlap with ABRs and are described in SEQ ID NOs: 225-242. In certain further embodiments, the binding region comprises or consists essentially of amino acids 269-499, 269-512, 269-513, or 280-510 of any one of SEQ ID NOs: 34, 35, 41-56, and 82.

A natural CD38 ligand or derivative thereof may be utilized as the binding region of a cell-targeting molecule of the present invention. Native CD38 is known to bind at least one ligand, CD38L, an Ig protein also known as platelet endothelial cell adhesion molecule 1 (PECAM1) or CD31 (Cesano A et al., *J Immunol* 160: 1106-15 (1998); Deaglio S et al., *J Immunol* 160: 395-402 (1998)). CD31 or a part of CD31 that interacts with CD38 or a derivative thereof may be fused to Shiga toxin effector polypeptides of the invention to construct CD38-targeting, cell-targeting molecules that bind an extracellular part of CD38.

Any of the aforementioned CD38 binding molecules may be suitable for use as a CD38 binding region or modified to create one or more CD38 binding regions for use in a cell-targeting molecule of the present invention.

6. Cell-Targeting Molecules Targeting Human CD45

CD45, also recognized in the art as PTPRC (protein tyrosine phosphatase, receptor type, C) and leukocyte common antigen (LCA), is a type I transmembrane, protein tyrosine phosphatase expressed on the cell surfaces of many differentiated hematopoietic cells, especially malignant, hematological cells, such as, e.g., lymphoma, B-cell chronic lymphocytic leukemia (B-CLL), hairy cell leukemia, and acute nonlymphocytic leukemia (AML) cells. While the name CD45 might refer to multiple proteins with related structures and polypeptide sequences from various species, for the purposes of the structural examples of this section, the term "CD45" refers to the protein tyrosine phosphatase proteins present in humans whose exact sequence might vary slightly based on the isoform and from individual to individual. With regard to humans, CD45 refers to the protein represented by the predominant polypeptide sequence UniProt Q6QIQ5 and, e.g., NCBI accession NP_563578.2 or NP_002829.3; however, different isoforms and variants exist due to splicing, polymorphisms and/or mutations (see e.g. Motta-Mena L et al., *J Biol Chem* 286: 20043-53 (2011); Marme F et al., *Breast Cancer Res Treat* 132: 819-31 (2012); Pokoyski C et al., *Genes Immun* 16: 519-27 (2015)). A skilled worker will be able to identify other CD45 proteins in humans, even if they differ from the referenced sequences.

There are numerous CD45 binding regions known to the skilled worker which may be associated with a Shiga toxin effector polypeptide of the present invention to create a cell-targeting molecule of the present invention. For purposes of the present invention, the term "CD45 binding region" refers to a molecular moiety (e.g. a proteinaceous molecule) or agent capable of specifically binding an extracellular part of a CD45 molecule with high affinity, such as, e.g., having a dissociation constant with regard to CD45 of $10^{-5}$ to $10^{-12}$ moles per liter. As used herein, CD45 binding refers to the ability to bind to an extracellular part of an isoform or variant of human CD45.

In certain embodiments, the CD45 binding region is an immunoglobulin-type binding region. In certain embodiments, the immunoglobulin-type, CD45 binding region is derived from an immunoglobulin, CD45 binding region, such as an antibody paratope capable of binding an extracellular part of CD45. In certain other embodiments, the immunoglobulin-type, CD45 binding region comprises an engineered polypeptide not derived from any immunoglobulin domain but which functions like an immunoglobulin, CD45 binding region by providing high-affinity binding to an extracellular part of CD45. This engineered polypeptide may optionally include polypeptide scaffolds comprising or consisting essentially of complementary determining regions and/or antigen binding regions from immunoglobulins as described herein.

There are numerous CD45 binding regions contemplated as components of the present invention. Non-limiting examples of immunoglobulin-type, CD45 binding regions include CD45-binding monoclonal antibodies and scFvs, such as, e.g., anti-CD45RB (see e.g., Luke P et al., *Curr Mol Med* 1: 533-43 (2001); Lin Y et al., *Cancer Res* 66: 3884-92 (2006)).

In certain embodiments, the cell-targeting molecule of the present invention comprises a binding region comprising an immunoglobulin-type polypeptide selected for specific and high-affinity binding to human CD45 and/or the cellular surface of a CD45+ cell. In certain embodiments of the cell-targeting molecule of the present invention, the binding region comprises a polypeptide(s) selected from the group consisting of: a) a heavy chain variable ($V_H$) domain comprising (i) a HABR1 comprising or consisting essentially of one of the amino acid sequences as shown in SEQ ID NO:243, SEQ ID NO:249, or SEQ ID NO:255; (ii) a HABR2 comprising or consisting essentially of one of the amino acid sequence as shown in SEQ ID NO:244, SEQ ID NO:250, or SEQ ID NO:256; and (iii) a HABR3 comprising or consisting essentially of one of the amino acid sequence as shown in SEQ ID NO:245, SEQ ID NO:251, or SEQ ID NO:257; and b) a light chain variable ($V_L$) domain comprising (i) a LABR1 comprising or consisting essentially of one of the amino acid sequence as shown in SEQ ID NO:246, SEQ ID NO:252, or SEQ ID NO:258; (ii) a LABR2 comprising or consisting essentially of one of the amino acid sequence as shown in SEQ ID NO:247, SEQ ID NO:253, or SEQ ID NO:259; and (iii) a LABR3 comprising or consisting essentially of one of the amino acid sequence as shown in SEQ ID NO:248, SEQ ID NO:254, or SEQ ID NO:260.

Any of the aforementioned CD45 binding molecules may be suitable for use as a CD45 binding region or modified to create one or more CD45 binding regions for use in a cell-targeting molecule of the present invention.

7. Cell-Targeting Molecules Targeting Human HER2

HER2, also recognized in the art as Receptor tyrosine-protein kinase erbB-2, is a transmembrane protein which functions as a cell surface receptor for transducing signals across the cellular membrane to intracellular regulators of cell proliferation and apoptosis. HER2 is also recognized in the art as Neu, erbB-2, p185, CD340, NGL, and HER2/neu (Coussens L et al., *Science* 230: 1132-39 (1985); King C et al., *Science* 229: 974-6 (1985); Semba K et al., *Proc Natl Acad Sci USA* 82: 6497-501 (1985); Yamamoto T et al., *Nature* 319:230-234 (1986); Kokai Y et al., *Proc Natl Acad Sci USA* 85: 5389-93 (1988); Disis M et al, *Cancer Res* 54: 16-20 (1994); Yoshino I et al., *J Immunol* 152: 2393-400 (1994) see, e.g., GenBank Acc. Nos. X03363; M17730; NM_004448; SEG_HLMHER20). While the name HER2 might refer to multiple proteins with related structures and polypeptide sequences from various species, for the purposes of the structural examples of this section, the term "HER2" refers to the epidermal growth factor receptor proteins present in humans whose exact sequence might vary slightly based on the isoform and from individual to individual. For example, HER2 refers to the human protein represented by the exemplary polypeptide sequences UniProt P04626 and NCBI accessions NP_004439.2, NP_001005862.1, NP_001276865.1, NP_001276866.1, and NP_001276867.1; however, different isoforms and variants exist due to splicing, polymorphisms and/or mutations (see e.g. Siddig A et al., *Ann NY Acad Sci* 1138: 84-94 (2008); Poole E et al., *Int J Mol Epidemiol Genet* 2: 300-15 (2011); W 2000/020579). A skilled worker will be able to identify other HER2 proteins in humans, even if they differ from the referenced sequences.

HER2 is overexpressed by many cancer cells, notably breast cancer cells, and its overexpression is strongly associated with increased metastasis, increased disease reoccurrence, and poor prognosis (see e.g. Slamon D et al., *Science* 235: 177-82 (1987)).

There are numerous HER2 binding regions known to the skilled worker which may be associated with a Shiga toxin effector polypeptide of the present invention to create a cell-targeting molecule of the present invention. For purposes of the present invention, the term "HER2 binding region" refers to a molecular moiety (e.g. a proteinaceous molecule) or agent capable of specifically binding an extracellular part of a HER2 molecule with high affinity, such as, e.g., having a dissociation constant with regard to CD20 of $10^{-5}$ to $10^{-12}$ moles per liter. As used herein, HER2 binding refers to the ability to bind to an extracellular part of an isoform or variant of human HER2.

In certain embodiments, the HER2 binding region is an immunoglobulin-type binding region. In certain embodiments, the immunoglobulin-type, HER2 binding region is derived from an immunoglobulin, HER2 binding region, such as an antibody paratope capable of binding an extracellular part of HER2. In certain other embodiments, the immunoglobulin-type, HER2 binding region comprises an engineered polypeptide not derived from any immunoglobulin domain but which functions like an immunoglobulin, HER2 binding region by providing high-affinity binding to an extracellular part of HER2. This engineered polypeptide may optionally include polypeptide scaffolds comprising or consisting essentially of complementary determining regions and/or antigen binding regions from immunoglobulins as described herein.

There are numerous HER2 binding regions contemplated as components of the present invention. Non-limiting examples of immunoglobulin-type, HER2 binding regions include HER2-binding monoclonal antibodies and derivatives thereof, such as, e.g., anti-ErbB2, 4D5, 2C4, 7F3, 7C2, mumAb 4D5, chmAb 4D5, (rhu)mAb 4D5, huMAb4D5-1, huMAb4D5-2, huMAb4D5-3, huMAb4D5-4, huMAb4D5-5, huMAb4D5-6, huMAb4D5-7, huMAb4D5-8, trastuzumab, humanized 520C9, 4D5Fc8, hingeless rhu4D5, non-glycosylated rhu4D5 with mutated cysteine residues, pertuzumab, and humanized 2C4 (Hudziak R et al., *Mol Cell Biol* 9: 1165-72 (1989); McKenzie S et al., *Oncogene* 4:543-8 (1989); Bacus S et al., *Molecular Carcinogenesis* 3: 350-62 (1990); Hancock M et al., *Cancer Res* 51: 4575-80 (1991); Maier L et al., *Cancer Res* 51: 5361-5369 (1991); Stancovski I et al., *Proc Natl Acad Sci USA* 88: 8691-5 (1991); Tagliabue E et al., *Int J Cancer* 47: 933-937 (1991); Bacus S et al., *Cancer Res* 52: 2580-9 (1992); Carter P et al., *Proc Natl Acad Sci USA* 89: 4285-89 (1992); Harwerth I et al. *J Biol Chem* 267: 15160-7 (1992); Kasprzyk P et al., *Cancer Res* 52: 2771-6 (1992); Lewis G et al., *Cancer Immunol Immunother* 37: 255-63 (1993); Xu F et al., *Int J Cancer* 53: 401-8 (1993); Arteaga C et al., *Cancer Res* 54: 3758-65 (1994); Shawyer L et al., *Cancer Res* 54: 1367-73 (1994); Klapper L et al. *Oncogene* 14: 2099-109 (1997); WO 1993/21319; WO 1994/00136; WO 1997/00271; WO 1998/77797; U.S. Pat. Nos. 5,772,997; 5,783,186; 5,821,337; 5,840,525; 6,949,245; and 7,625,859).

In certain embodiments, the cell-targeting molecule of the present invention comprises a binding region comprising an immunoglobulin-type polypeptide selected for specific and high-affinity binding to human HER2 and/or the cellular surface of a HER2+ cell. In certain embodiments of the cell-targeting molecule of the present invention, the binding region comprises a polypeptide(s) selected from the group consisting of: a) a heavy chain variable ($V_H$) domain comprising (i) a HABR1 comprising or consisting essentially of one of the amino acid sequences as shown in SEQ ID NO:261, SEQ ID NO:268, or SEQ ID NO:274; (ii) a HABR2 comprising or consisting essentially of one of the amino acid sequence as shown in SEQ ID NO:262, SEQ ID NO:269, or SEQ ID NO:275; and (iii) a HABR3 comprising or consisting essentially of one of the amino acid sequence as shown in SEQ ID NO:263, SEQ ID NO:267, SEQ ID NO:270, or SEQ ID NO:276; and b) a light chain variable ($V_L$) domain comprising (i) a LABR1 comprising or consisting essentially of one of the amino acid sequence as shown in SEQ ID NO:264, SEQ ID NO:271, or SEQ ID NO:277; (ii) a LABR2 comprising or consisting essentially of one of the amino acid sequence as shown in SEQ ID NO:265, SEQ ID NO:272, or SEQ ID NO:278; and (iii) a LABR3 comprising or consisting essentially of one of the amino acid sequence as shown in SEQ ID NO:266, SEQ ID NO:273, or SEQ ID NO:279. Alternatively, the binding regions could be described by CDRs, which largely overlap with ABRs and are described in SEQ ID NOs: 283-303. In other embodiments of the cell-targeting molecule of the present invention, the binding region comprises a polypeptide(s) selected from the group consisting of: a) a heavy chain only variable ($V_H$H) domain comprising (i) a HABR1 comprising or consisting essentially of the amino acid sequences as shown in SEQ ID NO:280; (ii) a HABR2 comprising or consisting essentially of the amino acid sequence as shown in SEQ ID NO:281; and (iii) a HABR3 comprising or consisting essentially of the amino acid sequence as shown in SEQ ID NO:282. In certain further embodiments, the binding region comprises or consists essentially of amino acids 269-520 or 269-521 of any one of SEQ ID NOs: 36, 66, and 67.

A natural ligand or derivative thereof may be utilized as the HER2 binding region for a cell-targeting molecule of the present invention. Native HER2 is known to heterodimerize with other members of the ErbB family upon binding ligands such as epidermal growth factors like epiregulin and heregulin (Moasser M, *Oncogene* 26: 6469-87 (2007); Riese D, Cullum R, *Semin Cell Dev Biol* 28: 49-56 (2014); Sollome J et al., *Cell Signal* 26: 70-82 (2014)). ErbB ligands which bind members of the ErbB family include EGF, TGF-α, amphiregulin, betacellulin, HB-EGF, epiregulin, HER2-68 and HER2-100, heregulins, herstatin, NRG-2, NRG-3, and NRG-4 (Justman Q et al., *J Biol Chem* 277: 20618-24 (2002); Jhabvala-Romero F., et al., *Oncogene* 22: 8178-86 (2003)). Examples of an ErbB ligand include the heregulins (HRG), such as the prototype heregulin disclosed in U.S. Pat. No. 5,641,869 and Marchionni M et al., *Nature* 362: 312-8 (1993). Examples of heregulins include heregulin-α, heregulin-β1, heregulin-β2 and heregulin-β3 (Holmes W et al., *Science* 256: 1205-10 (1992); U.S. Pat. No. 5,641,869); neu differentiation factor (NDF) (Peles et al., *Cell* 69: 205-16 (1992)); acetylcholine receptor-inducing activity (ARIA) (Falls D et al., *Cell* 72: 801-15 (1993)); glial growth factors (GGFs) (Marchionni M et al., *Nature* 362: 312-8 (1993)); sensory and motor neuron derived factor (SMDF) (Ho W et al., *J Biol Chem* 270: 14523-32 (1995)); γ-heregulin (Schaefer G et al., *Oncogene* 15: 1385-94 (1997)).

An ErbB ligand according to the present invention may also be a synthetic ErbB ligand. The synthetic ligand may be specific for a particular ErbB receptor, or may recognize particular ErbB receptor complexes. An example of a synthetic ligand is the synthetic heregulin/EGF chimera biregulin (Jones J et al., *FEBS Lett,* 447: 227-31 (1999)) and the EGF-like domain fragment HRG(31177-244. ErbB ligands or a part of an ErbB ligand that interacts with HER2 or a derivative thereof may be fused to Shiga toxin effector polypeptides of the invention to construct HER2-targeting, cell-targeting molecules of the invention that bind an extracellular part of HER2.

Synthetic peptides which bind an extracellular part of HER2 may be utilized as the binding region for targeting. Many peptides have been described which are capable of binding to HER2 (see e.g. U.S. Pat. Nos. 5,578,482; 5,856,110; 5,869,445; 5,985,553; 6,333,169; 6,987,088; 7,019,017; 7,282,365; 7,306,801; 7,435,797; 7,446,185; 7,449,480; 7,560,111; 7,674,460; 7,815,906, 7,879,325; 7,884,194; 7,993,650; 8,241,630; 8,349,585; 8,389,227; 8,501,909; 8,512,967; 8,652,474; and US 2011/0059090).

In certain embodiments, small molecules which bind an extracellular part of HER2 may be utilized as the binding region for targeting. Many small molecules have been described which are capable of binding to HER2 such as tyrosine kinase inhibitors, AZD8931, lapatinib, neratinib (HKI-272), dacomitinib (PF-00299804), afatinib (BIBW 2992) (Barlaam B et al., *ACS Med Chem Lett* 4: 742-6 (2013); Yu H, Riley G, *J Natl Compr Canc Netw* 11: 161-9 (2013); Roskoski R, *Pharmacol Res* 87C: 42-59 (2014)). Other small molecules which bind to an extracellular part of HER2 may be identified using methods well known to those of skill in the art, such as by derivatizing known EGFR binders like gefitinib, erlotinib, AEE788, AG1478, AG1571 (SU-5271), AP26113, CO-1686, XL647, vandetanib, and BMS-690514 (Kurokawa H, Arteaga C, *Clin Cancer Res* 7: 4436s-4442s (2001); Yigitbasi O et al., *Cancer Res* 64: 7977-84 (2004); Yu H, Riley G, *J Natl Compr Canc Netw* 11: 161-9 (2013); Roskoski R, *Pharmacol Res* 87C: 42-59 (2014)).

Any of the aforementioned HER2 binding molecules may be suitable for use as a HER2 binding region or modified to create one or more HER2 binding regions for use in a cell-targeting molecule of the present invention 8. Cell-Targeting Molecules Targeting Human PD-L1

PD-L1, also recognized in the art as PDL1, programmed cell death 1 ligand 1, PDCD1 Ligand 1, PDCD1L1, PDCD1LG1, B7 homolog 1 (B7-H1), and CD274, is a ligand for the programmed cell death-1 receptor of T- and B-cells (Dong H et al., *Nat Med* 5: 1365-9 (1999); Freeman G et al., *J Exp Med* 192: 1027-34 (2000); Latchman Y et al., *Nat Immunol* 2: 261-8 (2001)) and the B7-1 receptor and CD80 receptor found on T-cells (Butte M et al., *Immunity* 27:111-22 (2007); Park J et al., *Blood* 116: 1291-8 (2010)). While the name PD-L1 might refer to multiple proteins with related structures and polypeptide sequences from various species, for the purposes of the structural examples of this section, the term "PD-L1" refers to the PD-1 ligands present in humans whose exact sequence might vary slightly based on the isoform and from individual to individual. With regard to humans, PD-L1 refers to the protein represented by the predominant polypeptide sequence UniProt Q9NZQ7 or Q9EP73 and NCBI accession AAI13735.1; however, different isoforms and variants exist due to splicing, polymorphisms and/or mutations (see e.g. Abelson A et al., *Genes Immun* 8: 69-74 (2007); Wang S et al., *J Clin Immunol* 27: 563-7 (2007); Hayashi M et al., *Eur J Endocrinol* 158: 817-22 (2008); Mitchell A et al., *J Clin Endocrinol Metab* 94: 5139-45 (2009); Yang Q et al., *Clin Exp Rheumatol* 29: 13-8 (2011); Ma Y et al., *Int J Clin Exp Med* 15: 16585-91 (2015)). A skilled worker will be able to identify other PD-L1 proteins in humans, even if they differ from the referenced sequences.

PD-L1 is absent from most healthy tissues under normal conditions; however, PD-L1 expression can be induced by exposure of most nucleated mammalian cells to an interferon(s) (see e.g., Dong H et al., *Nat Med* 8: 793-800 (2002); Chen L, *Nat Rev Immunol* 4: 336-47 (2004); Hirano F et al., *Cancer Res* 65: 1089-96 (2005); Zou W, Chen L, *Nat Rev Immunol* 8: 467-7 (2008); Flies D et al., *Yale J Biol Med* 84: 409-21 (2011); Chen J et al., *Immunobiology* 217: 385-93 (2012); Spranger S et al. *Sci Transl Med* 5: 200ra116 (2013)). During certain malignancies, PD-L1 upregulation in tumor microenvironments might lead to over-suppression of immune responses to tumor cells, which fits common notions about PD-L1's involvement in adaptive immune resistance of tumor cells to a host's immune system (see e.g., Zou W, Chen L, *Nat Rev Immunol* 8: 467-7 (2008); Zheng P, Zho Z, *Biomark Cancer* 7: 15-8 (2015)).

PD-L1 is an attractive target for therapies because PD-L1 is strongly expressed by certain tumor cells and tumor-infiltrating lymphocytes whereas healthy, human tissues and cells seldom express high levels of PD-L1 at a cellular surface (see e.g. Dong H et al., *Nat Med* 8: 793-800 (2002); Chen L, *Nat Rev Immunol* 4: 336-47 (2004); Hirano F et al., *Cancer Res* 65: 1089-96 (2005); Chen L, Han X, *J Clin Invest* 125: 3384-91 (2015)). In humans, expression of cell-surface PD-L1 by tumor cells has been observed in a number of primary tumor biopsies and tumor-cell cultured cells assessed by immunohistochemistry, including cells and tissues related to, e.g., carcinomas, gliomas, B-cell lymphomas, adult T-cell leukemia/lymphoma (ATLL), angioimmunoblastic T-cell lymphomas (AITLs), bladder cancers, chronic lymphocytic leukemias (CLLs), epithelial malignancies, oral squamous cell carcinomas, esophageal squamous cell carcinomas (ESCCs), lung cancers, non-Hodgkin lymphomas (NHLs), pancreatic cancers, renal cell carcinomas (RCCs), small lymphocytic lymphomas (SLLs), squamous cell carcinomas of the head and neck (SCCHN), and virus-associated malignancies (see e.g., Brown J et al., *Immunol* 170: 1257-66 (2003); Strome S et al., *Cancer Res* 63: 6501-5 (2003); Wintterle et al., *Cancer Res* 63: 7462-7 (2003); Thompson R et al., *Cancer Res* 66: 3381-5 (2006); Nomi T et al., *Clin Cancer Res* 13: 2151-7 (2007); Thompson et al., *Clin Cancer Res* 13: 1757-61 (2007); Andorsky D et al., *Clin Cancer Res* 17: 4232-44 (2011); Chen B et al., *Clin Cancer Res* 19: 3462-73 (2013); Chen M et al., *Oncotarget* 7: 7913-24 (2016); Wu C et al., *Sci Rep* 6: 19740 (2016)).

There are numerous PD-LI binding regions known to the skilled worker which may be associated with a Shiga toxin effector polypeptide of the present invention to create a cell-targeting molecule of the present invention. For purposes of the present invention, the term "PD-L1 binding region" refers to a molecular moiety (e.g. a proteinaceous molecule) or agent capable of specifically binding an extracellular part of a PD-L1 molecule with high affinity, such as, e.g., having a dissociation constant with regard to PD-L1 of $10^{-5}$ to $10^{-12}$ moles per liter. As used herein, PD-L1 binding refers to the ability to bind to an extracellular part of an isoform or variant of human PD-LI.

In certain embodiments, the PD-L1 binding region is an immunoglobulin-type binding region. In certain embodiments, the immunoglobulin-type, PD-L1 binding region is derived from an immunoglobulin, PD-LI binding region, such as an antibody paratope capable of binding an extracellular part of PD-L1. In certain other embodiments, the immunoglobulin-type, PD-L1 binding region comprises an engineered polypeptide not derived from any immunoglobulin domain but which functions like an immunoglobulin, PD-L1 binding region by providing high-affinity binding to an extracellular part of PD-L1. This engineered polypeptide may optionally include polypeptide scaffolds comprising or consisting essentially of complementary determining regions and/or antigen binding regions from immunoglobulins as described herein.

There are numerous PD-LI binding regions contemplated as components of the present invention. Non-limiting examples of immunoglobulin-type, PD-L1 binding regions include numerous antibodies and immunoglobulin domains already known to bind an extracellular part of PD-L1 present at a cellular surface include MDX-1105, MOM-18534-S(P), and various scFvs (see e.g., Latchman Y et al., *Nat Immunol* 2: 261-8 (2001); Xerri L et al., *Human Pathol* 39: 1050-8 (2008); Chen B et al., *Clin Cancer Res* 19: 3462-73 (2013); Drees J et al., *Protein Expr Purf* 94: 60-6 (2014); WO 2007/005874; WO 2010/036959; WO 2013/019906; U.S. Pat. Nos. 7,943,743; 8,552,154; 9,102,727; 9,273,135, and U.S. patent applications US20110271358 and US20160075782).

In certain embodiments, the cell-targeting molecule of the present invention comprises a binding region comprising an immunoglobulin-type polypeptide selected for specific and high-affinity binding to human PD-L1 and/or the cellular surface of a PD-L1+ cell. In certain embodiments of the cell-targeting molecule of the present invention, the binding region comprises a polypeptide(s) selected from the group consisting of: a) a heavy chain variable ($V_H$) domain comprising (i) a HCDR1 comprising or consisting essentially of one of the amino acid sequences as shown in SEQ ID NO:304, SEQ ID NO:310, SEQ ID NO:316, SEQ ID NO:322, or SEQ ID NO:328; (ii) a HCDR2 comprising or consisting essentially of one of the amino acid sequence as shown in S SEQ ID NO:305, SEQ ID NO:311, SEQ ID NO:317, SEQ ID NO:323, or SEQ ID NO:329; and (iii) a HCDR3 comprising or consisting essentially of one of the amino acid sequence as shown in SEQ ID NO:306, SEQ ID NO:312, SEQ ID NO:318, SEQ ID NO:324, or SEQ ID NO:330; and b) a light chain variable ($V_L$) domain comprising (i) a LCDR1 comprising or consisting essentially of one of the amino acid sequence as shown in SEQ ID NO:307, SEQ ID NO:313, SEQ ID NO:319, SEQ ID NO:325, or SEQ ID NO:331; (ii) a LCDR2 comprising or consisting essentially of one of the amino acid sequence as shown in SEQ ID NO:308, SEQ ID NO:314, SEQ ID NO:320, SEQ ID NO:326, or SEQ ID NO:332; and (iii) a LCDR3 comprising or consisting essentially of one of the amino acid sequence as shown in SEQ ID NO:309, SEQ ID NO:315, SEQ ID NO:321, SEQ ID NO:327, or SEQ ID NO:333. In certain further embodiments, the binding region comprises or consists essentially of amino acids 269-498 or 269-499 of any one of SEQ ID NOs: 37-39, 68-79, and 81.

Any of the aforementioned PD-L1 binding molecules may be suitable for use as a PD-L1 binding region or modified to create one or more PD-L1 binding regions for use in a cell-targeting molecule of the present invention.

Other Structural Variations

In certain embodiments of the cell-targeting molecules of the present invention, the binding region has been previously described, e.g., in WO 2005/092917, WO 2007/033497, US2009/0156417, JP4339511, EP1727827, DE602004027168, EP1945660, JP4934761, EP2228383, US2013/0196928, WO 2014/164680, WO 2014/164693, WO 2015/138435, WO 2015/138452, WO 2015/113005, WO 2015/113007, WO 2015/191764, US20150259428, 62/168,758, 62/168,759, 62/168,760, 62/168,761, 62/168,762, 62/168,763, and PCT/US2016/016580.

In certain further embodiments of the cell-targeting molecule of the present invention, the binding region comprises a polypeptide(s) selected from the group consisting of: (a) a heavy chain variable ($V_H$) domain comprising a HCDR1 comprising or consisting essentially of the amino acid sequences as shown in SEQ ID NO:334, a HCDR2 comprising or consisting essentially of the amino acid sequences as shown in HCDR2, and a HCDR3 comprising or consisting essentially of the amino acid sequences as shown in SEQ ID NO:336; and (b) a light chain variable ($V_L$) domain comprising a LCDR1 comprising or consisting essentially of the amino acid sequences as shown in SEQ ID NO:337, a LCDR2 comprising or consisting essentially of the amino acid sequences as shown in SEQ ID NO:338, and a LCDR3 comprising or consisting essentially of the amino acid sequences as shown in SEQ ID NO:339.

It is within the scope of the present invention to use fragments, variants, and/or derivatives of the cell-targeting molecules of the present invention which contain a functional binding site to any extracellular part of a target biomolecule, and even more preferably capable of binding a target biomolecule with high affinity (e.g. as shown by $K_D$). For example, any binding region which binds an extracellular part of a target biomolecule with a dissociation constant ($K_D$) of $10^{-5}$ to $10^{-12}$ moles/liter, preferably less than 200 nM, may be substituted for use in making cell-targeting molecules of the invention and methods of the invention.

The skilled worker will recognize that variations may be made to the Shiga toxin effector polypeptides and cell-targeting molecules of the present invention, and polynucleotides encoding any of the former, without diminishing their biological activities, e.g., by maintaining the overall structure and function of the Shiga toxin effector polypeptide, such as in conjunction with one or more 1) endogenous epitope disruptions which reduce antigenic and/or immunogenic potential, 2) furin-cleavage motif disruptions which reduce proteolytic cleavage, and/or 3) embedded or inserted epitopes which reduce antigenic and/or immunogenic potential or are capable of being delivered to a MHC I molecule for presentation on a cell surface. For example, some modifications may facilitate expression, facilitate purification, improve pharmacokinetic properties, and/or improve immunogenicity. Such modifications are well known to the skilled worker and include, for example, a methionine added at the amino-terminus to provide an initiation site, additional amino acids placed on either terminus to create conveniently located restriction sites or termination codons, and biochemical affinity tags fused to either terminus to provide for convenient detection and/or purification. A common modification to improve the immunogenicity of a polypeptide produced using a non-chordate system (e.g. a prokaryotic cell) is to remove, after the production of the polypeptide, the starting methionine residue, which may be formylated during production, such as, e.g., in a bacterial host system, because, e.g., the presence of N-formylmethionine (fMet) might induce undesirable immune responses in chordates.

Also contemplated herein is the inclusion of additional amino acid residues at the amino and/or carboxy termini of a Shiga toxin effector polypeptide of the present invention, a cell-targeting molecule of the present invention, or a proteinaceous component of a cell-targeting molecules of the present invention, such as sequences for epitope tags or other moieties. The additional amino acid residues may be used for various purposes including, e.g., facilitating cloning, facilitating expression, post-translational modification, facilitating synthesis, purification, facilitating detection, and administration. Non-limiting examples of epitope tags and moieties are chitin binding protein domains, enteropeptidase cleavage sites, Factor Xa cleavage sites, FIAsH tags, FLAG tags, green fluorescent proteins (GFP), glutathione-S-transferase moieties, HA tags, maltose binding protein domains, myc tags, polyhistidine tags, ReAsH tags, strep-tags, strep-tag II, TEV protease sites, thioredoxin domains, thrombin cleavage site, and V5 epitope tags.

In certain of the above embodiments, the polypeptide sequence of the Shiga toxin effector polypeptides and/or cell-targeting molecules of the present invention are varied by one or more conservative amino acid substitutions introduced into the polypeptide region(s) as long as all required structural features are still present and the Shiga toxin effector polypeptide is capable of exhibiting any required function(s), either alone or as a component of a cell-targeting molecule. As used herein, the term "conservative substitution" denotes that one or more amino acids are replaced by another, biologically similar amino acid residue. Examples include substitution of amino acid residues with similar characteristics, e.g. small amino acids, acidic amino acids, polar amino acids, basic amino acids, hydrophobic amino acids and aromatic amino acids (see, for example, Table C). An example of a conservative substitution with a residue normally not found in endogenous, mammalian peptides and proteins is the conservative substitution of an arginine or lysine residue with, for example, ornithine, canavanine, aminoethylcysteine, or another basic amino acid. For further information concerning phenotypically silent substitutions in peptides and proteins see, e.g., Bowie J et al., *Science* 247: 1306-10 (1990).

TABLE C

Examples of Conservative Amino Acid Substitutions

| I | II | III | IV | V | VI | VII | VIII | IX | X | XI | XII | XIII | XIV |
|---|---|---|---|---|---|---|---|---|---|---|---|---|---|
| A | D | H | C | F | N | A | C | F | A | C | A | A | D |
| G | E | K | I | W | Q | G | M | H | C | D | C | C | E |
| P | Q | R | L | Y | S | I | P | W | F | E | D | D | G |
| S | N | | M | | T | L | | Y | G | H | G | E | K |
| T | | | V | | | V | | | H | K | N | G | P |
| | | | | | | | | | I | N | P | H | Q |
| | | | | | | | | | L | Q | S | K | R |
| | | | | | | | | | M | R | T | N | S |
| | | | | | | | | | R | S | V | Q | T |
| | | | | | | | | | T | T | | R | |
| | | | | | | | | | V | | | S | |
| | | | | | | | | | W | | | P | |
| | | | | | | | | | Y | | | T | |

In the conservative substitution scheme in Table C, exemplary conservative substitutions of amino acids are grouped by physicochemical properties—I: neutral, hydrophilic; II: acids and amides; III: basic; IV: hydrophobic; V: aromatic, bulky amino acids, VI hydrophilic uncharged, VII aliphatic uncharged, VIII non-polar uncharged, IX cycloalkenyl-associated, X hydrophobic, XI polar, XII small, XIII turn-permitting, and XIV flexible. For example, conservative amino acid substitutions include the following: 1) S may be substituted for C; 2) M or L may be substituted for F; 3) Y may be substituted for M; 4) Q or E may be substituted for K; 5) N or Q may be substituted for H; and 6) H may be substituted for N.

Additional conservative amino acid substitutions include the following: 1) S may be substituted for C; 2) M or L may be substituted for F; 3) Y may be substituted for M; 4) Q or E may be substituted for K; 5) N or Q may be substituted for H; and 6) H may be substituted for N.

In certain embodiments, the Shiga toxin effector polypeptides and cell-targeting molecules of the present invention may comprise functional fragments or variants of a polypeptide region of the present invention described herein that have, at most, 20, 15, 10, 9, 8, 7, 6, 5, 4, 3, 2, or 1 amino acid substitutions compared to a polypeptide sequence recited herein, as long as it (1) comprises at least one embedded or inserted, heterologous T-cell epitope and at least one amino acid is disrupted in an endogenous, B-cell and/or CD4+ T-cell epitope region provided in the Examples (see e.g. Tables 1-7 and/or 12), wherein the disrupted amino acid does not overlap with the embedded or inserted epitope; (2) comprises at least one embedded or inserted, heterologous T-cell epitope and a disrupted furin-cleavage motif at the carboxy-terminus of a Shiga toxin A1 fragment derived region; or (3) comprises a disrupted furin-cleavage motif at the carboxy-terminus of a Shiga toxin A1 fragment derived region and comprises at least one amino acid is disrupted in an endogenous, B-cell and/or CD4+ T-cell epitope region provided in the Examples (see e.g. Tables 1-7 and/or 12), wherein the disrupted amino acid does not overlap with the disrupted furin-cleavage motif. Variants of the Shiga toxin effector polypeptides and cell-targeting molecules of the invention are within the scope of the present invention as a result of changing a polypeptide described herein by altering one or more amino acid residues or deleting or inserting one or more amino acid residues, such as within the binding region or Shiga toxin effector polypeptide region, in order to achieve desired properties, such as changed cytotoxicity, changed cytostatic effects, changed immunogenicity, and/or changed serum half-life. The Shiga toxin effector polypeptides and cell-targeting molecules of the present invention may further be with or without a signal sequence.

Accordingly, in certain embodiments, the Shiga toxin effector polypeptides of the present invention comprise or consists essentially of amino acid sequences having at least 55%, 60%, 65%, 70%, 75%, 80%, 85%, 90%, 95%, 97%, 98%, or 99%, overall sequence identity to a naturally occurring Shiga toxin A Subunit or fragment thereof, such as, e.g., Shiga toxin A Subunit, such as SLT-1A (SEQ ID NO:1), StxA (SEQ ID NO:2), and/or SLT-2A (SEQ ID NO:3), wherein the Shiga toxin effector polypeptide (1) comprises at least one embedded or inserted, heterologous T-cell epitope and at least one amino acid is disrupted in an endogenous, B-cell and/or CD4+ T-cell epitope region provided in the Examples (see e.g. Tables 1-7 and/or 12), and wherein the disrupted amino acid does not overlap with the embedded or inserted epitope; (2) comprises at least one embedded or inserted, heterologous T-cell epitope and a disrupted furin-cleavage motif at the carboxy-terminus of a Shiga toxin A1 fragment derived region; or (3) comprises a disrupted furin-cleavage motif at the carboxy-terminus of a Shiga toxin A1 fragment derived region and comprises at least one amino acid is disrupted in an endogenous, B-cell and/or CD4+ T-cell epitope region provided in the Examples (see e.g. Tables 1-7 and/or 12), and wherein the disrupted amino acid does not overlap with the disrupted furin-cleavage motif.

In certain embodiments of the Shiga toxin effector polypeptides of the present invention, one or more amino acid residues may be mutated, inserted, or deleted in order to increase the enzymatic activity of the Shiga toxin effector polypeptide. In certain embodiments of the Shiga toxin effector polypeptides of the present invention, one or more amino acid residues may be mutated or deleted in order to reduce or eliminate catalytic and/or cytotoxic activity of the Shiga toxin effector polypeptide. For example, the catalytic and/or cytotoxic activity of the A Subunits of members of the Shiga toxin family may be diminished or eliminated by mutation or truncation.

The cytotoxicity of the A Subunits of members of the Shiga toxin family may be altered, reduced, or eliminated by mutation and/or truncation. The positions labeled tyrosine-77, glutamate-167, arginine-170, tyrosine-114, and tryptophan-203 have been shown to be important for the catalytic activity of Stx, Stx1, and Stx2 (Hovde C et al., *Proc Natl Acad Sci USA* 85: 2568-72 (1988); Deresiewicz R et al., *Biochemistry* 31: 3272-80 (1992); Deresiewicz R et al., *Mol Gen Genet* 241: 467-73 (1993); Ohmura M et al., *Microb Pathog* 15: 169-76 (1993); Cao C et al., *Microbiol Immunol* 38: 441-7 (1994); Suhan M, Hovde C, *Infect Immun* 66: 5252-9 (1998)). Mutating both glutamate-167 and arginine-170 eliminated the enzymatic activity of Slt-I A1 in a cell-free ribosome inactivation assay (LaPointe P et al., *J Biol Chem* 280: 23310-18 (2005)). In another approach using de novo expression of Slt-I A1 in the endoplasmic reticulum, mutating both glutamate-167 and arginine-170 eliminated Slt-I A1 fragment cytotoxicity at that expression level (LaPointe P et al., *J Biol Chem* 280: 23310-18 (2005)). A truncation analysis demonstrated that a fragment of StxA from residues 75 to 268 still retains significant enzymatic activity in vitro (Haddad J et al., *J Bacteriol* 175: 4970-8 (1993)). A truncated fragment of Slt-I A1 containing residues 1-239 displayed significant enzymatic activity in vitro and cytotoxicity by de novo expression in the cytosol (LaPointe P et al., *J Biol Chem* 280: 23310-18 (2005)). Expression of a Slt-I A1 fragment truncated to residues 1-239 in the endoplasmic reticulum was not cytotoxic because it could not retrotranslocate to the cytosol (LaPointe P et al., *J Biol Chem* 280: 23310-18 (2005)).

The most critical residues for enzymatic activity and/or cytotoxicity in the Shiga toxin A Subunits were mapped to the following residue-positions: asparagine-75, tyrosine-77, tyrosine-114, glutamate-167, arginine-170, arginine-176, and tryptophan-203 among others (Di R et al., *Toxicon* 57: 525-39 (2011)). In particular, a double-mutant construct of Stx2A containing glutamate-E167-to-lysine and arginine-176-to-lysine mutations was completely inactivated; whereas, many single mutations in Stx1 and Stx2 showed a 10-fold reduction in cytotoxicity. Further, truncation of Stx1A to 1-239 or 1-240 reduced its cytotoxicity, and similarly, truncation of Stx2A to a conserved hydrophobic residue reduced its cytotoxicity. The most critical residues for binding eukaryotic ribosomes and/or eukaryotic ribosome inhibition in the Shiga toxin A Subunit have been mapped to the following residue-positions arginine-172, arginine-176, arginine-179, arginine-188, tyrosine-189, valine-191, and leucine-233 among others (McCluskey A et al., *PLoS One* 7: e31191 (2012). However, certain modification may increase a Shiga toxin functional activity exhibited by a Shiga toxin effector polypeptide of the present invention. For example, mutating residue-position alanine- 231 in Stx1A to glutamate increased Stx1A's enzymatic activity in vitro (Suhan M, Hovde C, *Infect Immun* 66: 5252-9 (1998)).

In certain embodiments of Shiga toxin effector polypeptides of the present invention derived from SLT-1A (SEQ ID NO:1) or StxA (SEQ ID NO:2), the one or more amino acid residues mutated include substitution of the asparagine at position 75, tyrosine at position 77, tyrosine at position 114, glutamate at position 167, arginine at position 170, arginine at position 176, and/or substitution of the tryptophan at position 203. Examples of such substitutions will be known to the skilled worker based on the prior art, such as asparagine at position 75 to alanine, tyrosine at position 77 to serine, substitution of the tyrosine at position 114 to serine, substitution of the glutamate position 167 to glutamate, substitution of the arginine at position 170 to alanine, substitution of the arginine at position 176 to lysine, substitution of the tryptophan at position 203 to alanine, and/or substitution of the alanine at 231 with glutamate. Other mutations which either enhance or reduce Shiga toxin enzymatic activity and/or cytotoxicity are within the scope of the invention and may be determined using well known techniques and assays disclosed herein.

The Shiga toxin effector polypeptides and cell-targeting molecules of the present invention may optionally be conjugated to one or more additional agents, which may include therapeutic agents, diagnostic agents, and/or other additional exogenous materials known in the art, including such agents as described herein. In certain embodiments, the Shiga toxin effector polypeptide or cell-targeting molecule of the present invention is PEGylated or albuminated, such as, e.g., to provide de-immunization, disrupt furin-cleavage by masking the extended loop and/or the furin-cleavage motif at the carboxy-terminus of a Shiga toxin A1 fragment derived region, improve pharmacokinetic properties, and/or improve immunogenicity (see e.g., Wang Q et al., *Cancer Res* 53: 4588-94 (1993); Tsutsumi Y et al., *Proc Natl Acad Sci USA* 97: 8548-53 (2000); Buse J, El-Aneed A, *Nanomed* 5: 1237-60 (2010); Lim S et al., *J Control Release* 207-93 (2015)).

V. General Functions of the Cell-Targeting Molecules of the Present Invention

The functional association of Shiga toxin effector polypeptides of the present invention with cell-targeting binding regions enables the creation of cell-targeting molecules which selectively kill, inhibit the growth of, deliver exogenous material to, and/or detect specific cell types. The properties of the Shiga toxin effector polypeptide of the present invention enable the creation of cell-targeting molecules with improved therapeutic windows in chordates as compared to prior Shiga toxin effector polypeptides.

For certain embodiments, the cell-targeting molecule of the present invention provides, after administration to a chordate, one or more of the following: 1) potent and selective killing of targeted cells, e.g., infected or malignant cells, at low administration doses, 2) linkage stability between the cell-targeting binding region and the Shiga toxin effector polypeptide region while the cell-targeting molecule is present in extracellular spaces, 3) low levels of off-target cell deaths and/or unwanted tissue damage, and 4) cell-targeted delivery of heterologous, CD8+ T-cell epitopes for presentation by target cells in order to initiate desirable, T-cell mediated, immune responses, such as, e.g., the recruitment of CD8+ T-cells and the localized release of cytokines at a tissue locus.

The Shiga toxin effector polypeptides and cell-targeting molecules of the present invention are useful in diverse applications involving, e.g., cell-killing; cell growth inhibition; intracellular, cargo delivery; biological information gathering; immune response stimulation, and/or remediation of a health condition. The Shiga toxin effector polypeptides of the present invention are useful as components of various therapeutic and/or diagnostic molecules, such as, e.g. ligand-toxin fusions, immunotoxins, and/or immuno-conjugates. The cell-targeting molecules of the present invention are useful as therapeutic and/or diagnostic molecules, such as, e.g., as cell-targeting, cytotoxic, therapeutic molecules; cell-targeting, nontoxic, delivery vehicles; and/or cell-targeting, diagnostic molecules; for examples in applications involving the in vivo targeting of specific cell types for the diagnosis or treatment of a variety of diseases, including cancers, immune disorders, and microbial infections.

Depending on the embodiment, a Shiga toxin effector polypeptide or cell-targeting molecule of the present invention may have or provide one or more of the following characteristics or functionalities: (1) de-immunization, (2) protease-cleavage resistance, (3) potent cytotoxicity at certain concentrations, (4) intracellular delivery of a cargo consisting of an additional material (e.g. a heterologous, T-cell epitope), (4) selective cytotoxicity, (6) low off-target toxicity in multicellular organisms at certain doses or dosages, (7) delivery of a heterologous, T-cell epitope to the MHC class I presentation pathway of a target cell, and/or (8) stimulation of CD8+ T-cell immune response(s). Certain embodiments of the Shiga toxin effector polypeptides and cell-targeting molecules of the present invention are multi-functional because the molecules have two or more of the characteristics or functionalities described herein. Certain further embodiments of the cell-targeting molecules of the present invention provide all of the aforementioned characteristics and functionalities in a single molecule.

The associating, coupling, and/or linking of a cell-targeting binding region(s) with a Shiga toxin effector polypeptide(s) of the present invention enables the engineering of cell-targeting molecules with Shiga toxin function(s) that can produce less adverse effects after administration at certain doses or dosages to a multicellular organism such as a mammal. Non-limiting examples of adverse effects include off-target toxicities, untargeted cytotoxicities, and/or unwanted immune responses. Certain embodiments of the Shiga toxin effector polypeptides and cell-targeting molecules of the present invention are particularly useful in applications involving administration of a Shiga toxin effector polypeptide and/or cell-targeting molecule to a chordate because of functional properties, such as, e.g., de-immunization, reduced off-target toxicities, and/or targeted stimulation of desirable immune responses such as via cell-surface presentation of a cell-targeting molecule delivered, CD8+ T-cell epitope.

In certain embodiments, the cell-targeting molecules of the present invention are capable of binding extracellular target biomolecules associated with the cell surface of particular cell types and entering those cells. Once internalized within a targeted cell type, certain embodiments of the cell-targeting molecules of the invention are capable of routing an enzymatically active, cytotoxic, Shiga toxin effector polypeptide fragment into the cytosol of the target cell and eventually killing the cell. Alternatively, nontoxic or reduced-toxicity variants of the cell-targeting molecules of the present invention may be used to deliver additional exogenous materials into target cells, such as epitopes, peptides, proteins, polynucleotides, and detection promoting agents. This system is modular, in that any number of diverse binding regions can be used to target a Shiga toxin effector polypeptide of the present invention to various, diverse cell types.

A. De-Immunization for Applications Involving Administration to a Chordate

The de-immunization of the Shiga toxin effector polypeptides of the present invention is accomplished by engineering disruptions of one or more, endogenous, B-cell and/or CD4+ T-cell epitopes regions of a Shiga toxin A Subunit or Shiga toxin effector polypeptide, including via mutation and/or truncation or via the conjugation of a covalently-linked chemical structure. Because B-cell epitopes often coincide or overlap with epitopes of mature CD4+ T-cells, the disruption of an endogenous, B-cell epitope region often simultaneously disrupts an endogenous, CD4+ T-cell epitope or vice versa.

Certain embodiments of the Shiga toxin effector polypeptides and cell-targeting molecules of the present invention are de-immunized with respect to one or more B-cell and/or CD4+ T-cell epitopes meaning that these molecules exhibit reduced antigenic and/or immunogenic potential as compared to prior, Shiga toxin effector polypeptides and cell-targeting molecules lacking identical disruptions to the same B-cell and/or CD4+ T-cell epitope or epitope regions and/or lacking any disruption to the same B-cell and/or CD4+ T-cell epitope(s) or epitope region(s). Certain further embodiments exhibit potent if not wild-type levels of Shiga toxin A Subunit catalytic domain dependent cytotoxicity despite the presence of multiple mutations providing the de-immunized property. The de-immunized, Shiga toxin effector polypeptides and cell-targeting molecules of the present invention are useful for applications involving the parenteral administration of a Shiga toxin effector polypeptide and/or cell-targeting molecule to a chordate such as, e.g., a mammal, amphibian, bird, fish, reptiles, or shark, because of the reduced likelihood of producing undesirable immune responses invoked by the administrated molecule.

The various de-immunized, Shiga toxin effector polypeptides of the present invention might differ in their antigenicity profiles when administered to various chordate species, but all the de-immunized polypeptides of the invention exhibit reduced antigenicity and/or immunogenicity in at least one organism as measured by at least one quantitative assay. In particular, certain embodiments of the cell-targeting molecules of the present invention are de-immunized with respect to a mammalian recipient, such as, e.g., the molecule invokes lower quantities and/or frequencies of "anti-cell-targeting molecule" antibodies when administered to that mammal as compared to a reference molecule (e.g. a related cell-targeting molecule comprising a wild-type Shiga toxin A1 fragment). In addition, Shiga toxin effector polypeptides of the present invention having disruptions of multiple, endogenous, epitope regions are expected to more greatly reduced the probability of the occurrence of undesirable immune responses in a chordate recipient of such a polypeptide.

For certain embodiments of the Shiga toxin effector polypeptides and cell-targeting molecules of the present invention, the de-immunization property(ies) is a result of the structural change(s) which include the disrupted furin-cleavage motif at the carboxy-terminus of a Shiga toxin A1 fragment derived region.

For certain embodiments of the Shiga toxin effector polypeptides and cell-targeting molecules of the present invention, the de-immunization property(ies) is a result of the structural change(s) which include the embedding and/or inserting of a T-cell epitope which disrupts an endogenous, B-cell and/or CD4+ T-cell epitope region.

For certain embodiments, the desired biological function(s) of the parental, Shiga toxin polypeptide from which the de-immunized, Shiga toxin effector polypeptide was derived are preserved, such as, e.g., the Shiga toxin A Subunit functions of promoting cellular internalization, directing intracellular routing, and potent cytotoxicity. Preservation refers to the retention of a minimal level of activity as described herein.

B. Reduced Protease-Cleavage Sensitivity

Certain embodiments of the Shiga toxin effector polypeptides and cell-targeting molecules of the present invention exhibit reduced protease-cleavage sensitivity as compared to related molecules comprising wild-type, Shiga toxin A1 fragment regions. Certain further embodiments exhibit potent if not optimal, Shiga toxin A Subunit catalytic domain dependent cytotoxicity despite this reduced protease-cleavage sensitivity and lack of a canonical furin-cleavage event within an intoxicated cell.

Certain embodiments of the protease-cleavage resistant, cell-targeting molecules of the present invention (i.e. a cell-targeting molecule comprising a Shiga toxin effector polypeptide comprising a disrupted furin-cleavage motif at the carboxy-terminus of its Shiga toxin A1 fragment region) exhibit improved in vivo tolerability as compared to related molecules comprising a wild-type, Shiga toxin A1 fragment region. Certain further embodiments exhibit potent if not optimal, Shiga toxin A Subunit catalytic domain dependent cytotoxicity despite this reduced protease-cleavage sensitivity and lack of a canonical furin-cleavage event within an intoxicated cell.

Previously, it was believed that cytotoxic, Shiga toxin A Subunit constructs comprising Shiga toxin A1 fragment catalytic regions must maintain or somehow compensate for the naturally occurring proteolytic processing by furin within intoxicated cells in order to preserve the Shiga toxin's natural adaptations for efficient and potent cytotoxicity. It was unexpectedly discovered that the furin cleavage event was not required for potent cytotoxicity because potent Shiga toxin cytotoxicity at the level of a wild-type Shiga toxin control construct was achieved in the absence of any furin cleavage event at the carboxy-terminus of the Shiga toxin A1 fragment despite the presence of a carboxy-terminal moiety (see Examples, infra and WO 2015/191764). The lack of a furin-cleavage event within the intoxicated cell may prevent the efficient liberation of a Shiga toxin A1 fragment-like region and, thus, result in the continued linkage of a relatively large moiety (e.g. greater than 28 kDa in size) to the Shiga toxin A1 fragment region. However despite this possibility, potent, Shiga toxin cytotoxicity was achieved with furin-cleavage deficient constructs comprising a Shiga toxin effector polypeptide region and lacking any known compensatory feature(s), such as, e.g., providing intracellular cleavage proximal to the carboxy-terminus of a Shiga toxin A1 fragment derived region (see Examples, infra; WO 2015/191764).

This suggests that the persistence and/or inefficient release of a relatively large, molecular moiety linked to the A1 fragment region did not necessarily reduce the potency of Shiga toxin cytotoxicity. This was surprising because the optimal Shiga toxin intoxication process was thought to require liberation of the Shiga toxin A1 fragments from all other large molecular moieties to efficiently retrotranslocate liberated A1 fragments from the endoplasmic reticulum to the cytosol where the A1 fragments can form an enzymatically active structure that catalytically inactivates the intoxicated cell's ribosomes. In particular, the persistence and/or inefficient release of a relatively large molecular moiety covering the carboxy-terminus of the Shiga toxin A1 fragment was expected to interfere with the Shiga toxin A1 fragment's natural mechanism of efficiently gaining access to the cytosol, which involves the exposure of the A1 fragment's, hydrophobic, carboxy-terminal domain and recognition of this domain by the ERAD system (see Di R et al., *Toxicon* 57: 525-39 (2011); Li S et al., *PLoS One* 7: e41119 (2012)).

The lack of an intoxicated-cell-mediated, furin-cleavage event for a molecule comprising a Shiga toxin A Subunit derivative may be hypothetically compensated for. Non-limiting examples of potential, compensatory approaches include 1) terminating one carboxy-terminus of the construct with the carboxy-terminus of a Shiga toxin A1 fragment-like polypeptide region, 2) producing the Shiga toxin derived construct such that the Shiga toxin A Subunit polypeptide is already nicked near the carboxy-terminus of its Shiga toxin A1 fragment-like polypeptide, 3) engineering a heterologous and/or ectopic protease site that can functionally substitute for the lack of the native, Shiga toxin, furin-cleavage event, and 4) a combination of approach 3 and 4.

In the first approach, the carboxy-terminus of the Shiga toxin A1 fragment-like polypeptide is not covered by any carboxy-terminal moiety, and, thus, the carboxy-terminus of the Shiga toxin A1 fragment-like polypeptide is permanently exposed for recognition by the ERAD machinery in the endoplasmic reticulum. In the last three approaches, the Shiga toxin A1 fragment-like polypeptide can be designed to intracellularly dissociate from one or more other components of the construct by the time the molecule reaches the endoplasmic reticulum of an intoxicated cell such that in the endoplasmic reticulum the carboxy-terminus of the Shiga toxin A1 fragment-like polypeptide becomes exposed for recognition by the ERAD machinery. For example, a cytotoxic molecule comprising a Shiga toxin A Subunit effector polypeptide could be pretreated with a protease to nick the polypeptide region near the carboxy terminus of the A1 fragment-like region prior to contacting a target cell. Alternatively, the cytotoxic molecule could be engineered to comprise a protease site which is cleaved by an intracellular protease of the target cell.

These hypothetical approaches for designing Shiga toxin A Subunit effector polypeptides which compensate for the lack of an intoxicated-cell-mediated, furin-cleavage event may significantly alter the efficiency and potency of cytotoxicity as compared to a wild-type Shiga holotoxin or Shiga toxin A Subunit construct comprising only wild-type sequences which include the optimal, naturally occurring, furin-cleavage site. For example, currently no compensatory approach relying on a target cell endoprotease other than furin is known which can provide fully compensatory cytotoxicity equivalent to furin cleavage and alternative cellular proteases to furin like calpains have been shown to be less efficient in facilitating Shiga toxin cytotoxicity (Garred O et al., *Exp Cell Res* 218: 39-49 (1995); Garred O et al., *J Biol Chem* 270: 10817-21 (1995); Kurmanova A et al., *Biochem Biophys Res Commun* 357: 144-9 (2007)).

The present invention provides furin-cleavage resistant Shiga toxin A Subunit effector polypeptides which are potently cytotoxic, whether due to compensation for a lack of a furin cleavage event within the intoxicated cell or due to some unexplained reason. Certain cell-targeting molecules of the present invention are at least as efficiently and potently cytotoxic as cell-targeting molecules comprising protease-cleavage sensitive, wild-type Shiga toxin effector polypeptide regions (see Examples, infra).

C. Improved Stability and In Vivo Tolerability

In certain embodiments, the molecules of the present invention (e.g. cell-targeting molecules of the invention) exhibit increased stability and/or improved in vivo tolerability as compared to more furin-cleavage sensitive analogs and/or less de-immunized analogs (an analog being a closely related molecule lacking one or more structural features of the present invention).

The increased stability of a cell-targeting molecule compared to a reference molecule can be exhibited in vitro and/or in vivo. The stability of a therapeutic or diagnostic molecule over time is an important feature and can affect for which applications the molecule may be practically employed. Molecular stability includes in vitro and in vivo, such as, e.g., stability within an organism after administration and during storage over a range of temperatures and concentrations. For certain immunotoxins or ligand-toxin fusions, the stability of the linkage between the toxin and other components can affect the amount of non-specific toxicity caused by the presence and/or quantity of untargeted toxin over time within the organism.

Certain cell-targeting molecules of the present invention exhibit reduced non-specific toxicity in vivo, manifested as increased in vivo tolerability as compared to more protease-cleavage sensitive variants. In vivo tolerability can be determined by the skilled worker using techniques known in the art and/or described herein. In addition to assessing in vivo tolerability using mortality, signs of morbidity may be used for assessing in vivo tolerability, such as, e.g., aspects of body weight, physical appearance, measureable clinical signs, unprovoked behavior, and responses to external stimuli (see e.g. Morton D, Griffiths P, *Vet Rec* 116: 431-43 (1985); Montgomery C, *Cancer Bull* 42: 230-7 (1990); Ullman-Culleré M, Foltz C, *Lab Anim Sci* 49: 319-23 (1999); Clingerman K, Summers L, *J Am Assoc Lab Anim Sci* 51: 31-6 (2012)). Euthanasia may be used in response to signs of morbidity and/or morbundity and, thus, create a mortality time-point. For example, a decrease in body weight of 15-20% in 2-3 days can be used as a sign of morbidity in rodents and as a justification for euthanization (see e.g. Institute of Laboratory Animal Research 2011. *Guide for the care and use of laboratory animals,* 8th ed., Washington, D.C., U.S.: National Academies Press).

The improved in vivo tolerability observed for exemplary, cell-targeting molecules of the present invention as compared to more furin-cleavage sensitive analogs suggests that much higher doses of these cell-targeting molecules of the invention may be safely administered to mammals as compared to the doses of related molecules comprising a furin-cleavage sensitive, Shiga toxin effector polypeptide region. Certain cell-targeting molecules of the invention might exhibit reduced non-specific toxicity as compared to more protease sensitive variants because the protease resistance serves to protect and preserve the linkage between the Shiga toxin effector component and the cell-targeting moiety component.

In addition, in vivo tolerability for cell-targeting molecules of the present invention may be related to the de-immunization properties of a given cell-targeting molecule. Thus, higher doses of such de-immunized, cell-targeting molecules of the invention may be safely administered to mammals as compared to the doses of related molecules comprising an "un-de-immunized" or less de-immunized, Shiga toxin effector polypeptide (e.g. a wild-type Shiga toxin A1 fragment).

In addition, certain molecules of the invention exhibit increased half-lives, both in vitro and/or in vivo, as compared to more protease-cleavage sensitive variants. Molecular stability can be assayed by determining the half-life of a molecule of interest with regard to the association of its components. Certain embodiments of the molecules of the invention will have longer half-lives as compared to furin-cleavage sensitive variants, especially with regard to the continued association of the Shiga toxin effector polypeptide component and one or more other components. For example, certain embodiments of the molecules of the invention will have longer half-lives with regard to the continued association of the Shiga toxin effector polypeptide component and another component, e.g. a cell-targeting binding region, as compared to a furin-cleavage sensitive variant wherein the furin-cleavage sensitive site(s) lies between those two components.

D. Cell-Kill Via Shiga Toxin A Subunit Cytotoxicity

Certain embodiments of the Shiga toxin effector polypeptides and cell-targeting molecules of the present invention are cytotoxic. Certain further embodiments of the cell-targeting molecules of the present invention are cytotoxic only due to the presence of one or more Shiga toxin effector polypeptide components. The A Subunits of members of the Shiga toxin family each comprise an enzymatically active polypeptide region capable of killing a eukaryotic cell once in the cell's cytosol. Because members of the Shiga toxin family are adapted to killing eukaryotic cells, molecules derived from Shiga toxins, such as, e.g., molecules comprising certain embodiments of the Shiga toxin effector polypeptides of the present invention can exhibit potent cell-kill activities.

For certain embodiments of the cell-targeting molecules of the present invention, upon contacting a cell physically coupled with an extracellular target biomolecule of the binding region of the cell-targeting molecule (e.g. a target positive cell), the cell-targeting molecule is capable of causing death of the cell. For certain further embodiments, the $CD_{50}$ value of the cell-targeting molecule is less than 5, 2.5, 1, 0.5, or 0.25 nM, which is vastly more potent than an untargeted, wild-type, Shiga toxin effector polypeptide (e.g. SEQ ID NO:4).

Cell-kill may be accomplished using a molecule of the present invention under varied conditions of target cells, such as, e.g., an ex vivo manipulated target cell, a target cell cultured in vitro, a target cell within a tissue sample cultured in vitro, or a target cell in an in vivo setting like within a multicellular organism.

In certain embodiments, the Shiga toxin effector polypeptides and cell-targeting molecules of the present invention comprise (1) a de-immunized, Shiga toxin effector sub-region, (2) a protease-cleavage resistant region near the carboxy-terminus of a Shiga toxin A1 fragment derived region, (3) a carboxy-terminal, endoplasmic reticulum retention/retrieval signal motif, and/or (4) a heterologous, T-cell epitope embedded or inserted region; however, for certain further embodiments, these structural modifications do not significantly alter the potency of Shiga toxin cytotoxicity as compared to a reference molecules comprising a wild-type Shiga toxin A Subunit polypeptide, such as, e.g., a wild-type Shiga toxin A1 fragment. Thus, Shiga toxin effector polypeptides and cell-targeting molecules of the present invention which are de-immunized, protease cleavage resistant, and/or carrying embedded or inserted, heterologous, epitopes can maintain potent cytotoxicity while providing one or more various other functionalities or properties.

Already cytotoxic cell-targeting molecules comprising Shiga toxin effector polypeptides may be engineered by the skilled worker using the information and methods provided herein to be more cytotoxic and/or to have redundant, backup cytotoxicities operating via completely different mechanisms. These multiple cytotoxic mechanisms may complement each other by their diversity of functions (such as by providing potent killing via two mechanisms of cell-killing, direct and indirect, as well as mechanisms of immuno-stimulation to the local area), redundantly backup each other (such as by providing one cell-killing mechanism in the absence of the other mechanisms-like if a target cell is resistant to or acquires some immunity to a subset of previously active mechanisms), and/or protect against developed resistance (by limiting resistance to the less probable situation of the malignant or infected cell blocking multiple, different cell-killing mechanisms simultaneously).

E. Delivery of a T-Cell Epitope for MHC Class I Presentation on a Cell Surface

In certain embodiments, the Shiga toxin effector polypeptides and cell-targeting molecules of the present invention comprise a T-cell epitope, which enables the engineering of "T-cell epitope delivering" molecules with virtually unlimited choices of epitope-peptide cargos for delivery and cell-surface presentation by a nucleated, chordate cell. For certain embodiments, the Shiga toxin effector polypeptides and cell-targeting molecules of the present invention are each capable of delivering one or more T-cell epitopes, associated with the Shiga toxin effector polypeptides and/or cell-targeting molecules, to the proteasome of a cell. The delivered T-cell epitope are then proteolytic processed and presented by the MHC class I pathway on the surface of the cell. By engineering MHC class I epitopes into cell-targeting molecules, the targeted delivery and presentation of immuno-stimulatory antigens may be accomplished in order to harness and direct a beneficial function(s) of a chordate immune system.

For certain embodiments, the Shiga toxin effector polypeptide or cell-targeting molecule of the present invention is capable of delivering a T-cell epitope to a MHC class I molecule of a cell for cell-surface presentation. In certain embodiments, the Shiga toxin effector polypeptide or cell-targeting molecule of the present invention comprises a heterologous, T-cell epitope, whether as an additional exogenous material or embedded or inserted within a Shiga toxin effector polypeptide. For certain further embodiments, the Shiga toxin effector polypeptide or cell-targeting molecule of the present invention is capable of delivering an embedded or inserted T-cell epitope to a MHC class I molecule for cell-surface presentation.

For certain embodiments, the Shiga toxin effector polypeptide of the present invention is capable of delivering a T-cell epitope, which is embedded or inserted in the Shiga toxin effector polypeptide, to a MHC class I molecule of a cell in which the Shiga toxin effector polypeptide is present for presentation of the T-cell epitope by the MHC class I molecule on a surface of the cell. For certain further embodiments, the T-cell epitope is a heterologous, T-cell epitope. For certain further embodiments, the T-cell epitope functions as CD8+ T-cell epitope, whether already known or identified in the future using methods which are currently routine to the skilled worker.

For certain embodiments, the cell-targeting molecule of the present invention is capable of delivering a T-cell epitope, which is associated with the cell-targeting molecule, to a MHC class I molecule of a cell for presentation of the T-cell epitope by the MHC class I molecule on a surface of the cell. For certain further embodiments, the T-cell epitope is a heterologous, T-cell epitope which is embedded or inserted in the Shiga toxin effector polypeptide. For certain further embodiments, the T-cell epitope functions as CD8+ T-cell epitope, whether already known or identified in the future using methods which are currently routine to the skilled worker.

For certain embodiments, upon contacting a cell with the cell-targeting molecule of the present invention, the cell-targeting molecule is capable of delivering a T-cell epitope-peptide, which is associated with the cell-targeting molecule, to a MHC class I molecule of the cell for presentation of the T-cell epitope-peptide by the MHC class I molecule on a surface of the cell. For certain further embodiments, the T-cell epitope-peptide is a heterologous epitope which is embedded or inserted in a Shiga toxin effector polypeptide. For certain further embodiments, the T-cell epitope-peptide functions as CD8+ T-cell epitope, whether already known or identified in the future using methods which are currently routine to the skilled worker.

The addition of a heterologous epitope into or presence of a heterologous epitope in a cell-targeting molecule of the present invention, whether as an additional exogenous material or embedded or inserted within a Shiga toxin effector polypeptide, enables methods of using such cell-targeting molecules for the cell-targeted delivery of a chosen epitope for cell-surface presentation by a nucleated, target cell within a chordate.

One function of certain, CD8+ T-cell hyper-immunized, Shiga toxin effector polypeptides and cell-targeting molecules of the present invention is the delivery of one or more T-cell epitope-peptides to a MHC class I molecule for MHC class I presentation by a cell. Delivery of exogenous, T-cell epitope-peptides to the MHC class I system of a target cell can be used to induce the target cell to present the T-cell epitope-peptide in association with MHC class I molecules on the cell surface, which subsequently leads to the activation of CD8+ effector T-cells to attack the target cell.

The skilled worker, using techniques known in the art, can associate, couple, and/or link certain, Shiga toxin effector polypeptides of the present invention to various other cell-targeting binding region to create cell-targeting molecules of the present invention which target specific, extracellular, target biomolecules physically coupled to cells and promote target-cell internalization of these cell-targeting molecules. All nucleated vertebrate cells are believed to be capable of presenting intracellular epitopes using the MHC class I system. Thus, extracellular target biomolecules of the cell-targeting molecules of the invention may in principle target any nucleated vertebrate cell for T-cell epitope delivery to a MHC class I presentation pathway of such a cell.

The epitope-delivering functions of the Shiga toxin effector polypeptides and cell-targeting molecules of the present invention can be detected and monitored by a variety of standard methods known in the art to the skilled worker and/or described herein. For example, the ability of cell-targeting molecules of the present invention to deliver a T-cell epitope-peptide and drive presentation of the epitope-peptide by the MHC class I system of target cells may be investigated using various in vitro and in vivo assays, including, e.g., the direct detection/visualization of MHC class I/peptide complexes, measurement of binding affinities for the heterologous, T-cell epitope-peptide to MHC class I molecules, and/or measurement of functional consequences of MHC class I-peptide complex presentation on target cells by monitoring cytotoxic T-lymphocyte (CTL) responses (see e.g. Examples, infra).

Certain assays to monitor this function of the polypeptides and molecules of the present invention involve the direct detection of a specific MHC class/peptide antigen complex in vitro or ex vivo. Common methods for direct visualization and quantitation of peptide-MHC class I complexes involve various immuno-detection reagents known to the skilled worker. For example, specific monoclonal antibodies can be developed to recognize a particular MHC/class/peptide antigen complex. Similarly, soluble, multimeric T cell receptors, such as the TCR-STAR reagents (Altor Bioscience Corp., Mirmar, Fla., U.S.) can be used to directly visualize or quantitate specific MHC I/antigen complexes (Zhu X et al., *J Immunol* 176: 3223-32 (2006)). These specific mAbs or soluble, multimeric T-cell receptors may be used with various detection methods, including, e.g. immunohistochemistry, flow cytometry, and enzyme-linked immuno assay (ELISA).

An alternative method for direct identification and quantification of MHC I/peptide complexes involves mass spectrometry analyses, such as, e.g., the ProPresent Antigen Presentation Assay (ProImmune, Inc., Sarasota, Fla., U.S.) in which peptide-MCH class I complexes are extracted from the surfaces of cells, then the peptides are purified and identified by sequencing mass spectrometry (Falk K et al., *Nature* 351: 290-6 (1991)).

In certain assays to monitor the T-cell epitope delivery and MHC class I presentation function of the polypeptides and molecules of the present invention involve computational and/or experimental methods to monitor MHC class I and peptide binding and stability. Several software programs are available for use by the skilled worker for predicting the binding responses of peptides to MHC class I alleles, such as, e.g., The Immune Epitope Database and Analysis Resource (IEDB) Analysis Resource MHC-I binding prediction Consensus tool (Kim Y et al., *Nucleic Acid Res* 40: W525-30 (2012). Several experimental assays have been routinely applied, such as, e.g., cell surface binding assays and/or surface plasmon resonance assays to quantify and/or compare binding kinetics (Miles K et al., *Mol Immunol* 48: 728-32 (2011)). Additionally, other MHC-peptide binding assays based on a measure of the ability of a peptide to stabilize the ternary MHC-peptide complex for a given MHC class I allele, as a comparison to known controls, have been developed (e.g., MHC-peptide binding assay from ProImmmune, Inc.).

Alternatively, measurements of the consequence of MHC class/peptide antigen complex presentation on the cell surface can be performed by monitoring the cytotoxic T-cell (CTL) response to the specific complex. These measurements by include direct labeling of the CTLs with MHC class I tetramer or pentamer reagents. Tetramers or pentamers bind directly to T cell receptors of a particular specificity, determined by the Major Histocompatibility Complex (MHC) allele and peptide complex. Additionally, the quantification of released cytokines, such as interferon gamma or interleukins by ELISA or enzyme-linked immunospot (ELIspot) is commonly assayed to identify specific CTL responses. The cytotoxic capacity of CTL can be measured using a number of assays, including the classical 51 Chromium (Cr) release assay or alternative non-radioactive cytotoxicity assays (e.g., CytoTox96® non-radioactive kits and CellTox™ CellTiter-GLO® kits available from Promega Corp., Madison, Wis., U.S.), Granzyme B ELISpot, Caspase Activity Assays or LAMP-1 translocation flow cytometric assays. To specifically monitor the killing of target cells, carboxyfluorescein diacetate succinimidyl ester (CFSE) can be used to easily and quickly label a cell population of interest for in vitro or in vivo investigation to monitor killing of epitope specific CSFE labeled target cells (Durward M et al., *J Vis Exp* 45 pii 2250 (2010)).

In vivo responses to MHC class I presentation can be followed by administering a MHC class I/antigen promoting agent (e.g., a peptide, protein or inactivated/attenuated virus vaccine) followed by challenge with an active agent (e.g. a virus) and monitoring responses to that agent, typically in comparison with unvaccinated controls. Ex vivo samples can be monitored for CTL activity with methods similar to those described previously (e.g. CTL cytotoxicity assays and quantification of cytokine release).

HLA-A, HLA-B, and/or HLA-C molecules are isolated from the intoxicated cells after lysis using immune affinity (e.g., an anti-MHC antibody "pulldown" purification) and the associated peptides (i.e., the peptides presented by the isolated MHC molecules) are recovered from the purified complexes. The recovered peptides are analyzed by sequencing mass spectrometry. The mass spectrometry data is compared against a protein database library consisting of the sequence of the exogenous (non-self) peptide (T-cell epitope X) and the international protein index for humans (representing "self" or non-immunogenic peptides). The peptides are ranked by significance according to a probability database. All detected antigenic (non-self) peptide sequences are listed. The data is verified by searching against a scrambled decoy database to reduce false hits (see e.g. Ma B, Johnson R, *Mol Cell* Proteomics 11:0111.014902 (2012)). The results will demonstrate that peptides from the T-cell epitope X are presented in MHC complexes on the surface of intoxicated target cells.

The set of presented peptide-antigen-MHC complexes can vary between cells due to the antigen-specific HLA molecules expressed. T-cells can then recognize specific peptide-antigen-MHC complexes displayed on a cell surface using different TCR molecules with different antigen-specificities.

Because multiple T-cell epitopes may be delivered by a cell-targeting molecule of the invention, such as, e.g., by embedding two or more different T-cell epitopes in a single proteasome delivering effector polypeptide, a single cell-targeting molecule of the invention may be effective chordates of the same species with different MHC class variants, such as, e.g., in humans with different HLA alleles. This may allow for the combining within a single molecule of different T-cell epitopes with different effectiveness in different sub-populations of subjects based on MHC complex protein diversity and polymorphisms. For example, human MHC complex proteins, HLA proteins, vary among humans based on genetic ancestry, e.g. African (sub-Saharan), Amerindian, Caucasiod, Mongoloid, New Guinean and Australian, or Pacific islander.

The applications involving the T-cell epitope delivering polypeptides and molecules of the present invention are vast. Every nucleated cell in a mammalian organism may be capable of MHC class I pathway presentation of immunogenic, T-cell epitope-peptides on their cell outer surfaces complexed to MHC class I molecules. In addition, the sensitivity of T-cell epitope recognition is so exquisite that only a few MIC-I peptide complexes are required to be presented to result in an immune response, e.g., even presentation of a single complex can be sufficient for recognition by an effector T-cell (Sykulev Y et al., *Immunity* 4: 565-71 (1996)).

The activation of T-cell responses are desired characteristics of certain anti-cancer, anti-neoplastic, anti-tumor, and/or anti-microbial biologic drugs to stimulate the patient's own immune system toward targeted cells. Activation of a robust and strong T-cell response is also a desired characteristic of many vaccines. The presentation of a T-cell epitope by a target cell within an organism can lead to the activation of robust immune responses to a target cell and/or its general locale within an organism. Thus, the targeted delivery of a T-cell epitope for presentation may be utilized for as a mechanism for activating T-cell responses during a therapeutic regime.

The presentation of a T-cell immunogenic epitope-peptide by the MHC class I system targets the presenting cell for killing by CTL-mediated lysis and also triggers immune stimulation in the local microenvironment. By engineering immunogenic epitope sequences within Shiga toxin effector polypeptide components of target-cell-internalizing therapeutic molecules, the targeted delivery and presentation of immuno-stimulatory antigens may be accomplished. The presentation of immuno-stimulatory non-self antigens, such as e.g. known viral antigens with high immunogenicity, by target cells signals to other immune cells to destroy the target cells as well as to recruit more immune cells to the area.

The presentation of an immunogenic, T-cell epitope-peptide by the MHC class I complex targets the presenting cell for killing by CTL-mediated cytolysis. The presentation by targeted cells of immuno-stimulatory non-self antigens, such as, e.g., known viral epitope-peptides with high immunogenicity, can signal to other immune cells to destroy the target cells and recruit more immune cells to the target cell site within a chordate.

Thus, already cytotoxic molecules, such as e.g. therapeutic or potentially therapeutic molecules comprising Shiga toxin effector polypeptides, may be engineered using methods of the present invention into more cytotoxic molecules and/or to have an additional cytotoxic mechanism operating via delivery of a T-cell epitope, presentation, and stimulation of effector T-cells. These multiple cytotoxic mechanisms may complement each other (such as by providing both direct target-cell-killing and indirect (CTL-mediated) cell-killing, redundantly backup each other (such as by providing one mechanism of cell-killing in the absence of the other), and/or protect against the development of therapeutic resistance (by limiting resistance to the less probable situation of the malignant or infected cell evolving to block two different cell-killing mechanisms simultaneously).

In addition, a cytotoxic molecule comprising a Shiga toxin effector polypeptide region that exhibits catalytic-based cytotoxicity may be engineered by the skilled worker using routine methods into enzymatically inactive variants. For example, the cytotoxic Shiga toxin effector polypeptide component of a cytotoxic molecule may be conferred with reduced activity and/or rendered inactive by the introduction of one or mutations and/or truncations such that the resulting molecule can still be cytotoxic via its ability to deliver a T-cell epitope to the MHC class I system of a target cell and subsequent presentation to the surface of the target cell. In another example, a T-cell epitope may be inserted or embedded into a Shiga toxin effector polypeptide such that the Shiga toxin effector polypeptide is inactivated by the added epitope (see e.g. WO 2015/113007). This approach removes one cytotoxic mechanism while retaining or adding another and may also provide a molecule capable of exhibiting immuno-stimulation to the local area of a target cell(s) within an organism via delivered T-cell epitope presentation or "antigen seeding." Furthermore, non-cytotoxic variants of the cell-targeting molecules of the present invention which comprise embedded or inserted, heterologous, T-cell epitopes may be useful in applications involving immune-stimulation within a chordate and/or labeling of target cells within a chordate with MHC class I molecule displayed epitopes.

The ability to deliver a T-cell epitope of certain Shiga toxin effector polypeptides and cell-targeting molecules of the present invention may be accomplished under varied conditions and in the presence of non-targeted bystander cells, such as, e.g., an ex vivo manipulated target cell, a target cell cultured in vitro, a target cell within a tissue sample cultured in vitro, or a target cell in an in vivo setting like within a multicellular organism.

F. Cell-Kill Via Targeted Cytotoxicity and/or Engagement of Cytotoxic T-Cells

For certain embodiments, the cell-targeting molecule of the present invention can provide 1) delivery of a T-cell epitope for MHC class I presentation by a target cell and/or 2) potent cytotoxicity. For certain embodiments of the cell-targeting molecules of the present invention, upon contacting a cell physically coupled with an extracellular target biomolecule of the cell-targeting binding region, the cell-targeting molecule of the invention is capable of causing death of the cell. The mechanism of cell-kill may be direct, e.g. via the enzymatic activity of a toxin effector polypeptide region, or indirect via CTL-mediated cytolysis. 1. Indirect Cell-Kill via T-Cell Epitope Delivery and MHC Class I Presentation Certain embodiments of the cell-targeting molecules of the present invention are cytotoxic because they comprise a CD8+ T-cell epitope capable of being delivered to the MHC class I presentation pathway of a target cell and presented on a cellular surface of the target cell. For example, T-cell epitope delivering, CD8+ T-cell hyper-immunized, Shiga toxin effector polypeptides of the present invention, with or without endogenous epitope de-immunization, may be used as components of cell-targeting molecules for applications involving indirect cell-killing.

In certain embodiments of the cell-targeting molecules of the present invention, upon contacting a cell physically coupled with an extracellular target biomolecule of the cell-targeting binding region, the cell-targeting molecule of the invention is capable of indirectly causing the death of the cell, such as, e.g., via the presentation of one or more T-cell epitopes by the target cell and the subsequent recruitment of CTLs which kill the target cell.

The presentation of an antigenic peptide complexed with a MHC class I molecule by a cell sensitizes the presenting cell to targeted killing by cytotoxic T-cells (CTLs) via the induction of apoptosis, lysis, and/or necrosis. In addition, the CTLs which recognize the target cell may release immuno-stimulatory cytokines, such as, e.g., interferon gamma (IFN-gamma), tumor necrosis factor alpha (TNF), macrophage inflammatory protein-1 beta (MIP-1beta), and interleukins such as IL-17, L-4, and IL-22. Furthermore, CTLs activated by recognition of a presented epitope may indiscriminately kill other cells proximal to the presenting cell regardless of the peptide-MHC class I complex repertoire presented by those proximal cells (Wiedemann A et al., *Proc Natl Acad Sci USA* 103: 10985-90 (2006)).

Because of MHC allele diversity within different species, a cell-targeting molecule of the present invention comprising only a single epitope may exhibit varied effectiveness to different patients or subjects of the same species. However, certain embodiments of the cell-targeting molecules of the present invention may each comprise multiple, T-cell epitopes that are capable of being delivered to the MHC class I system of a target cell simultaneously. Thus, for certain embodiments of the cell-targeting molecules of the present invention, a cell-targeting molecule is used to treat different subjects with considerable differences in their MHC molecules' epitope-peptide binding affinities (i.e. considerable differences in their MHC alleles and/or MHC genotypes). In addition, certain embodiments of the cell-targeting molecules of the present invention reduce or prevent target cell adaptations to escape killing (e.g. a target cancer cell mutating to escape therapeutic effectiveness or "mutant escape") by using multiple cell-killing mechanisms simultaneously (e.g. direct killing and indirect killing via multiple different T-cell epitopes simultaneously).

2. Direct Cell-Kill Via Cell-Targeted, Shiga Toxin Cytotoxicity

Certain embodiments of the cell-targeting molecules of the present invention are cytotoxic because they comprise a catalytically active, Shiga toxin effector polypeptide and regardless of the presence of an immunogenic, CD8+ T-cell epitope in the molecule. For example, CD8+ T-cell hyper-immunized, Shiga toxin effector polypeptides of the present invention, with or without endogenous epitope de-immunization, may be used as components of cell-targeting molecules for applications involving direct cell-killing, such as, e.g., via the ribotoxic, enzymatic activity of a Shiga toxin effector polypeptide or ribosome binding and interference with ribosome function due to a non-catalytic mechanism(s).

For certain embodiments of the CD8+ T-cell hyper-immunized, cell-targeting molecules of the present invention, upon contacting a cell physically coupled with an extracellular target biomolecule of the cell-targeting binding region, the cell-targeting molecule of the invention is capable of directly causing the death of the cell, such as, e.g., without the involvement of a untargeted, cytotoxic T-cell (see Section V-D, supra).

G. Selective Cytotoxicity Among Cell Types

Certain cell-targeting molecules of the present invention have uses in the selective killing of specific target cells in the presence of untargeted, bystander cells. By targeting the delivery of Shiga toxin effector polypeptides of the present invention to specific cells via a cell-targeting binding region(s), the cell-targeting molecules of the present invention can exhibit cell-type specific, restricted cell-kill activities resulting in the exclusive or preferential killing selected cell types in the presence of untargeted cells. Similarly, by targeting the delivery of immunogenic T-cell epitopes to the MHC class I pathway of target cells, the subsequent presentation of T-cell epitopes and CTL-mediated cytolysis of target cells induced by the cell-targeting molecules of the invention can be restricted to exclusively or preferentially killing selected cell types in the presence of untargeted cells. In addition, both the cell-targeted delivery of a cytotoxic, Shiga toxin effector polypeptide region and an immunogenic, T-cell epitope can be accomplished by a single cell-targeting molecule of the present invention such that deliver of both potentially cytotoxic components is restricted exclusively or preferentially to target cells in the presence of untargeted cells.

For certain embodiments, the cell-targeting molecule of the present invention is cytotoxic at certain concentrations. In certain embodiments, upon administration of the cell-targeting molecule of the present invention to a mixture of cell types, the cytotoxic cell-targeting molecule is capable of selectively killing those cells which are physically coupled with an extracellular target biomolecule compared to cell types not physically coupled with an extracellular target biomolecule. For certain embodiments, the cytotoxic cell-targeting molecule of the present invention is capable of selectively or preferentially causing the death of a specific cell type within a mixture of two or more different cell types. This enables targeting cytotoxic activity to specific cell types with a high preferentiality, such as a 3-fold cytotoxic effect, over "bystander" cell types that do not express the target biomolecule. Alternatively, the expression of the target biomolecule of the binding region may be non-exclusive to one cell type if the target biomolecule is expressed in low enough amounts and/or physically coupled in low amounts with cell types that are not to be targeted. This enables the targeted cell-killing of specific cell types with a high preferentiality, such as a 3-fold cytotoxic effect, over "bystander" cell types that do not express significant amounts of the target biomolecule or are not physically coupled to significant amounts of the target biomolecule.

For certain further embodiments, upon administration of the cytotoxic cell-targeting molecule to two different populations of cell types, the cytotoxic cell-targeting molecule is capable of causing cell death as defined by the half-maximal cytotoxic concentration ($CD_{50}$) on a population of target cells, whose members express an extracellular target biomolecule of the binding region of the cytotoxic cell-targeting molecule, at a dose at least three-times lower than the $CD_{50}$ dose of the same cytotoxic cell-targeting molecule to a population of cells whose members do not express an extracellular target biomolecule of the binding region of the cytotoxic cell-targeting molecule.

For certain embodiments, the cytotoxic activity of a cell-targeting molecule of the present invention toward populations of cell types physically coupled with an extracellular target biomolecule is at least 3-fold higher than the cytotoxic activity toward populations of cell types not physically coupled with any extracellular target biomolecule of the binding region. According to the present invention, selective cytotoxicity may be quantified in terms of the ratio (a/b) of (a) cytotoxicity towards a population of cells of a specific cell type physically coupled with a target biomolecule of the binding region to (b) cytotoxicity towards a population of cells of a cell type not physically coupled with a target biomolecule of the binding region. In certain embodiments, the cytotoxicity ratio is indicative of selective cytotoxicity which is at least 3-fold, 5-fold, 10-fold, 15-fold, 20-fold, 25-fold, 30-fold, 40-fold, 50-fold, 75-fold, 100-fold, 250-fold, 500-fold, 750-fold, or 1000-fold higher for populations of cells or cell types physically coupled with a target biomolecule of the binding region compared to populations of cells or cell types not physically coupled with a target biomolecule of the binding region.

For certain embodiments, the preferential cell-killing function or selective cytotoxicity of a cell-targeting molecule of the present invention is due to an additional exogenous material (e.g. a cytotoxic material) and/or heterologous, T-cell epitope present in a Shiga toxin effector polypeptide of the present invention and not necessarily a result of the catalytic activity of a Shiga toxin effector polypeptide region.

This preferential cell-killing function allows a targeted cell to be killed by certain cytotoxic, cell-targeting molecules of the present invention under varied conditions and in the presence of non-targeted bystander cells, such as ex vivo manipulated mixtures of cell types, in vitro cultured tissues with mixtures of cell types, or in vivo in the presence of multiple cell types (e.g. in situ or in a native location within a multicellular organism).

H. Delivery of Additional Exogenous Material into the Interior of Targeted Cells In addition to cytotoxic, cytostatic, and immune stimulation applications, cell-targeting molecules of the present invention optionally may be used for targeted intracellular delivery functions, such as, e.g., in applications involving information gathering and diagnostic functions.

Because the cell-targeting molecules of the invention, including reduced cytotoxicity and/or nontoxic forms thereof, are capable of entering cells physically coupled with an extracellular target biomolecule recognized by the cell-targeting molecule's binding region, certain embodiments of the cell-targeting molecules of the invention may be used to deliver additional exogenous materials into the interior of targeted cell types. For example, non-toxic variants of the cytotoxic, cell-targeting molecules of the invention, or optionally cytotoxic variants, may be used to deliver additional exogenous materials to and/or label the interiors of cells physically coupled with an extracellular target biomolecule of the binding region of the cell-targeting molecule. Various types of cells and/or cell populations which express target biomolecules to at least one cellular surface may be targeted by the cell-targeting molecules of the invention for receiving exogenous materials. The functional components of the present invention are modular, in that various Shiga toxin effector polypeptides, additional exogenous materials, and binding regions may be associated with each other to provide cell-targeting molecules suitable for diverse applications involving cargo delivery, such as, e.g., non-invasive, in vivo imaging of tumor cells.

This delivery of exogenous material function of certain cell-targeting molecules of the present invention may be accomplished under varied conditions and in the presence of non-targeted bystander cells, such as, e.g., an ex vivo manipulated target cell, a target cell cultured in vitro, a target cell within a tissue sample cultured in vitro, or a target cell in an in vivo setting like within a multicellular organism. Furthermore, the selective delivery of exogenous material to certain cells by certain cell-targeting molecules of the present invention may be accomplished under varied conditions and in the presence of non-targeted bystander cells, such as ex vivo manipulated mixtures of cell types, in vitro cultured tissues with mixtures of cell types, or in vivo in the presence of multiple cell types (e.g. in situ or in a native location within a multicellular organism).

Shiga toxin effector polypeptides and cell-targeting molecules which are not capable, such as a certain concentration ranges, of killing a target cell and/or delivering an embedded or inserted epitope for cell-surface presentation by a MHC molecule of a target cell may still be useful for delivering exogenous materials into cells, such as, e.g., detection promoting agents.

For certain embodiments, the Shiga toxin effector polypeptides of the present invention exhibits low to zero cytotoxicity and thus are referred to herein as "noncytotoxic and/or reduced cytotoxic." For certain embodiments, the cell-targeting molecule of the present invention exhibits low to zero cytotoxicity and may be referred to as "noncytotoxic" and/or "reduced cytotoxic variants." For example, certain embodiments of the molecules of the present invention do not exhibit a significant level of Shiga toxin based cytotoxicity wherein at doses of less than 1000 nM, 500 nM, 100 nM, 75 nM, 50 nM, there is no significant amount of cell death as compared to the appropriate reference molecule, such as, e.g., as measured by an assay known to the skilled worker and/or described herein. For certain further embodiments, the molecules of the present invention do not exhibit any toxicity at dosages of 1-100 μg per kg of a mammalian recipient. Reduced-cytotoxic variants may still be cytotoxic at certain concentrations or dosages but exhibit reduced cytotoxicity, such as, e.g., are not capable of exhibiting a significant level of Shiga toxin cytotoxicity in certain situations.

Shiga toxin effector polypeptides of the present invention, and certain cell-targeting molecules comprising the same, can be rendered non-cytotoxic, such as, e.g., via the addition of one or more amino acid substitutions known to the skilled worker to inactive a Shiga toxin A Subunit and/or Shiga toxin effector polypeptide, including exemplary substitutions described herein. The non-cytotoxic and reduced cytotoxic variants of the cell-targeting molecules of the present invention may be in certain situations more suitable for delivery of additional exogenous materials than more cytotoxic variants.

Information Gathering for Diagnostic Functions

In certain cell-targeting molecules of the present invention have uses in the in vitro and/or in vivo detection of specific cells, cell types, and/or cell populations, as well as specific subcellular compartments of any of the aforementioned. Reduced-cytotoxicity and/or nontoxic forms of the cytotoxic, cell-targeting molecules of the invention that are conjugated to detection promoting agents optionally may be used for diagnostic functions, such as for companion diagnostics used in conjunction with a therapeutic regimen comprising the same or a related binding region, such as, e.g., a binding region with high-affinity binding to the same target biomolecule, an overlapping epitope, and/or the same epitope.

In certain embodiments, the cell-targeting molecules described herein are used for both diagnosis and treatment, or for diagnosis alone. When the same cytotoxic cell-targeting molecule is used for both diagnosis and treatment, for certain embodiments of the present invention the cell-targeting molecule variant which incorporates a detection promoting agent for diagnosis may have its cytotoxicity reduced or may be rendered nontoxic by catalytic inactivation of its Shiga toxin effector polypeptide region(s) via one or more amino acid substitutions, including exemplary substitutions described herein. For example, certain nontoxic variants of the cell-targeting molecules of the present invention exhibit less than 5%, 4%, 3%, 2%, or 1% death of target cells after administration of a dose less than 1 mg/kg. Reduced-cytotoxicity variants may still be cytotoxic at certain concentrations or dosages but exhibit reduced cytotoxicity, such as, e.g., are not capable of exhibiting a significant level of Shiga toxin cytotoxicity as described herein.

The ability to conjugate detection promoting agents known in the art to various cell-targeting molecules of the present invention provides useful compositions for the detection of certain cells, such as, e.g., cancer, tumor, immune, and/or infected cells. These diagnostic embodiments of the cell-targeting molecules of the invention may be used for information gathering via various imaging techniques and assays known in the art. For example, diagnostic embodiments of the cell-targeting molecules of the invention may be used for information gathering via imaging of intracellular organelles (e.g. endocytotic, Golgi, endoplasmic reticulum, and cytosolic compartments) of individual cancer cells, immune cells, and/or infected cells in a patient or biopsy sample.

Various types of information may be gathered using the diagnostic embodiments of the cell-targeting molecules of the invention whether for diagnostic uses or other uses. This information may be useful, for example, in diagnosing neoplastic cell types, determining therapeutic susceptibilities of a patient's disease, assaying the progression of anti-neoplastic therapies over time, assaying the progression of immunomodulatory therapies over time, assaying the progression of antimicrobial therapies over time, evaluating the presence of infected cells in transplantation materials, evaluating the presence of unwanted cell types in transplantation materials, and/or evaluating the presence of residual tumor cells after surgical excision of a tumor mass.

For example, subpopulations of patients might be ascertained using information gathered using the diagnostic variants of the cell-targeting molecules of the invention, and then individual patients could be further categorized into subpopulations based on their unique characteristic(s) revealed using those diagnostic embodiments. For example, the effectiveness of specific pharmaceuticals or therapies might be a criterion used to define a patient subpopulation. For example, a nontoxic diagnostic variant of a particular cytotoxic, cell-targeting molecule of the invention may be used to differentiate which patients are in a class or subpopulation of patients predicted to respond positively to a cytotoxic variant of that cell-targeting molecule of the invention. Accordingly, associated methods for patient identification, patient stratification, and diagnosis using cell-targeting molecules of the present invention, including nontoxic variants of cytotoxic, cell-targeting molecules of the present invention, are considered to be within the scope of the present invention.

The expression of the target biomolecule by a cell need not be native in order for cell-targeting by a cell-targeting molecule of the present invention, such as, e.g., for direct cell-kill, indirect cell-kill, delivery of exogenous materials like T-cell epitopes, and/or information gathering. Cell surface expression of the target biomolecule could be the result of an infection, the presence of a pathogen, and/or the presence of an intracellular microbial pathogen. Expression of a target biomolecule could be artificial such as, for example, by forced or induced expression after infection with a viral expression vector, see e.g. adenoviral, adeno-associated viral, and retroviral systems. An example of inducing expression of a target biomolecule is the upregulation of CD38 expression of cells exposed to retinoids, like all-trans retinoic acid and various synthetic retinoids, or any retinoic acid receptor (RAR) agonist (Drach J et al., *Cancer Res* 54: 1746-52 (1994); Uruno A et al., *J Leukoc Biol* 90: 235-47 (2011)). Expression of CD30 can be induced in both B-cells and T-cells by exposure to by mitogens, phytohemagglutinin (PHA), staphylococcal protein A, EBV virus, human T-cell leukemia virus 1 or 2 (HTLV-1 or HTLV-2) (see e.g. Stein H et al., *Blood* 66: 848-58 (1985)). In another example, CD20, HER2, and EGFR expression may be induced by exposing a cell to ionizing radiation (Wattenberg M et al., *Br J Cancer* 110: 1472-80 (2014)). Further, PSMA expression is upregulated in response to androgen deprivation (see e.g. Chang S et al., *Cancer* 88: 407-15 (2000); Meller B et al., *EJNMAI Res* 5: 66 (2015)).

VI. Production, Manufacture, and Purification of Shiga Toxin Effector Polypeptides of the Invention and Cell-Targeting Molecules Comprising the Same The Shiga toxin effector polypeptides and certain cell-targeting molecules of the present invention may be produced using techniques well known to those of skill in the art. For example, Shiga toxin effector polypeptides and cell-targeting molecules of the invention may be manufactured by standard synthetic methods, by use of recombinant expression systems, or by any other suitable method. Thus, Shiga toxin effector polypeptides and cell-targeting molecules of the invention may be synthesized in a number of ways, including, e.g. methods comprising: (1) synthesizing a polypeptide or polypeptide component of a cell-targeting molecule using standard solid-phase or liquid-phase methodology, either stepwise or by fragment assembly, and isolating and purifying the final polypeptide compound product; (2) expressing a polynucleotide that encodes a protein or protein component of a cell-targeting molecule of the invention in a host cell and recovering the expression product from the host cell or host cell culture; or (3) cell-free, in vitro expression of a polynucleotide encoding a polypeptide or polypeptide component of a cell-targeting molecule of the invention, and recovering the expression product; or by any combination of the methods of (1), (2) or (3) to obtain fragments of the protein component, subsequently joining (e.g. ligating) the peptide or polypeptide fragments to obtain a polypeptide component, and recovering the polypeptide component.

It may be preferable to synthesize a Shiga toxin effector polypeptide of the present invention, cell-targeting molecule of the present invention, or a protein component of a cell-targeting molecule of the invention by means of solid-phase or liquid-phase peptide synthesis. Polypeptides and cell-targeting molecules of the present invention may suitably be manufactured by standard synthetic methods. Thus, peptides may be synthesized by, e.g. methods comprising synthesizing the peptide by standard solid-phase or liquid-phase methodology, either stepwise or by fragment assembly, and isolating and purifying the final peptide product. In this context, reference may be made to WO 1998/011125 or, inter alia, Fields G et al., *Principles and Practice of Solid-Phase Peptide Synthesis* (Synthetic Peptides, Grant G, ed., Oxford University Press, U.K., 2nd ed., 2002) and the synthesis examples therein.

Shiga toxin effector polypeptides and cell-targeting molecules of the present invention may be prepared (produced and purified) using recombinant techniques well known in the art. In general, methods for preparing proteins by culturing host cells transformed or transfected with a vector comprising the encoding polynucleotide and purifying or recovering the protein from cell culture are described in, e.g., Sambrook J et al., *Molecular Cloning: A Laboratory Manual* (Cold Spring Harbor Laboratory Press, NY, U.S., 1989); Dieffenbach C et al., *PCR Primer: A Laboratory Manual* (Cold Spring Harbor Laboratory Press, N.Y., U.S., 1995). Any suitable host cell may be used to produce a polypeptide and/or cell-targeting protein of the invention. Host cells may be cells stably or transiently transfected, transformed, transduced or infected with one or more expression vectors which drive expression of a polypeptide of the invention. In addition, a Shiga toxin effector polypeptide and/or cell-targeting molecule of the invention may be produced by modifying the polynucleotide encoding a polypeptide or cell-targeting protein of the invention that result in altering one or more amino acids or deleting or inserting one or more amino acids in order to achieve desired properties, such as changed cytotoxicity, changed cytostatic effects, and/or changed serum half-life.

There are a wide variety of expression systems which may be chosen to produce a polypeptide or cell-targeting protein of the present invention. For example, host organisms for expression of cell-targeting proteins of the invention include prokaryotes, such as *E. coli* and *B. subtilis*, eukaryotic cells, such as yeast and filamentous fungi (like *S. cerevisiae, P. pastoris, A. awamori*, and *K. lactis*), algae (like *C. reinhardtii*), insect cell lines, mammalian cells (like CHO cells), plant cell lines, and eukaryotic organisms such as transgenic plants (like *A. thaliana* and *N. benthamiana*).

Accordingly, the present invention also provides methods for producing a Shiga toxin effector polypeptide and/or cell-targeting molecule of the present invention according to above recited methods and using a polynucleotide encoding part or all of a polypeptide of the invention or a protein component of a cell-targeting protein of the invention, an expression vector comprising at least one polynucleotide of the invention capable of encoding part or all of a polypeptide or cell-targeting protein of the invention when introduced into a host cell, and/or a host cell comprising a polynucleotide or expression vector of the invention.

When a protein is expressed using recombinant techniques in a host cell or cell-free system, it is advantageous to separate (or purify) the desired protein away from other components, such as host cell factors, in order to obtain preparations that are of high purity or are substantially homogeneous. Purification can be accomplished by methods well known in the art, such as centrifugation techniques, extraction techniques, chromatographic and fractionation techniques (e.g. size separation by gel filtration, charge separation by ion-exchange column, hydrophobic interaction chromatography, reverse phase chromatography, chromatography on silica or cation-exchange resins such as DEAE and the like, chromatofocusing, and Protein A Sepharose chromatography to remove contaminants), and precipitation techniques (e.g. ethanol precipitation or ammonium sulfate precipitation). Any number of biochemical purification techniques may be used to increase the purity of a polypeptide and/or cell-targeting molecule of the present invention. In certain embodiments, the polypeptides and cell-targeting molecules of the invention may optionally be purified in homo-multimeric forms (e.g. a molecular complex comprising two or more polypeptides or cell-targeting molecules of the invention).

In the Examples below are descriptions of non-limiting examples of methods for producing exemplary, Shiga toxin effector polypeptides and cell-targeting molecules of the present invention, as well as specific but non-limiting aspects of production methods.

VII. Pharmaceutical and Diagnostic Compositions Comprising Cell-Targeting Molecules of the Present Invention The present invention provides Shiga toxin effector polypeptides and cell-targeting molecules for use, alone or in combination with one or more additional therapeutic agents, in a pharmaceutical composition, for treatment or prophylaxis of conditions, diseases, disorders, or symptoms described in further detail below (e.g. cancers, malignant tumors, non-malignant tumors, growth abnormalities, immune disorders, and microbial infections). The present invention further provides pharmaceutical compositions comprising a Shiga toxin polypeptide or cell-targeting molecule of the present invention, or a pharmaceutically acceptable salt or solvate thereof, according to the invention, together with at least one pharmaceutically acceptable carrier, excipient, or vehicle. In certain embodiments, the pharmaceutical composition of the present invention may comprise homo-multimeric and/or hetero-multimeric forms of a Shiga toxin effector polypeptides or cell-targeting molecule of the present invention. The pharmaceutical compositions of the invention are useful in methods of treating, ameliorating, or preventing a disease, condition, disorder, or symptom described in further detail below. Each such disease, condition, disorder, or symptom is envisioned to be a separate embodiment with respect to uses of a pharmaceutical composition according to the invention. The invention further provides pharmaceutical compositions for use in at least one method of treatment according to the invention, as described in more detail below.

As used herein, the terms "patient" and "subject" are used interchangeably to refer to any organism, commonly vertebrates such as humans and animals, which presents symptoms, signs, and/or indications of at least one disease, disorder, or condition. These terms include mammals such as the non-limiting examples of primates, livestock animals (e.g. cattle, horses, pigs, sheep, goats, etc.), companion animals (e.g. cats, dogs, etc.) and laboratory animals (e.g. mice, rabbits, rats, etc.).

As used herein, "treat," "treating," or "treatment" and grammatical variants thereof refer to an approach for obtaining beneficial or desired clinical results. The terms may refer to slowing the onset or rate of development of a condition, disorder or disease, reducing or alleviating symptoms associated with it, generating a complete or partial regression of the condition, or some combination of any of the above. For the purposes of this invention, beneficial or desired clinical results include, but are not limited to, reduction or alleviation of symptoms, diminishment of extent of disease, stabilization (e.g. not worsening) of state of disease, delay or slowing of disease progression, amelioration or palliation of the disease state, and remission (whether partial or total), whether detectable or undetectable. "Treat," "treating," or "treatment" can also mean prolonging survival relative to expected survival time if not receiving treatment. A subject (e.g. a human) in need of treatment may thus be a subject already afflicted with the disease or disorder in question. The terms "treat," "treating," or "treatment" includes inhibition or reduction of an increase in severity of a pathological state or symptoms relative to the absence of treatment, and is not necessarily meant to imply complete cessation of the relevant disease, disorder, or condition. With regard to tumors and/or cancers, treatment includes reduction in overall tumor burden and/or individual tumor size.

As used herein, the terms "prevent," "preventing," "prevention" and grammatical variants thereof refer to an approach for preventing the development of, or altering the pathology of, a condition, disease, or disorder. Accordingly, "prevention" may refer to prophylactic or preventive measures. For the purposes of this invention, beneficial or desired clinical results include, but are not limited to, prevention or slowing of symptoms, progression or development of a disease, whether detectable or undetectable. A subject (e.g. a human) in need of prevention may thus be a subject not yet afflicted with the disease or disorder in question. The term "prevention" includes slowing the onset of disease relative to the absence of treatment, and is not necessarily meant to imply permanent prevention of the relevant disease, disorder or condition. Thus "preventing" or "prevention" of a condition may in certain contexts refer to reducing the risk of developing the condition, or preventing or delaying the development of symptoms associated with the condition.

As used herein, an "effective amount" or "therapeutically effective amount" is an amount or dose of a composition (e.g. a therapeutic composition, compound, or agent) that produces at least one desired therapeutic effect in a subject, such as preventing or treating a target condition or beneficially alleviating a symptom associated with the condition. The most desirable therapeutically effective amount is an amount that will produce a desired efficacy of a particular treatment selected by one of skill in the art for a given subject in need thereof. This amount will vary depending upon a variety of factors understood by the skilled worker, including but not limited to the characteristics of the therapeutic composition (including activity, pharmacokinetics, pharmacodynamics, and bioavailability), the physiological condition of the subject (including age, sex, disease type, disease stage, general physical condition, responsiveness to a given dosage, and type of medication), the nature of the pharmaceutically acceptable carrier or carriers in the formulation, and the route of administration. One skilled in the clinical and pharmacological arts will be able to determine a therapeutically effective amount through routine experimentation, namely by monitoring a subject's response to administration of a composition and adjusting the dosage accordingly (see e.g. *Remington: The Science and Practice of Pharmacy* (Gennaro A, ed., Mack Publishing Co., Easton, Pa., U.S., 19th ed., 1995)).

Diagnostic compositions of the present invention comprise a cell-targeting molecule of the present invention and one or more detection promoting agents. When producing or manufacturing a diagnostic composition of the present invention, a cell-targeting molecule of the present invention may be directly or indirectly linked to one or more detection promoting agents. There are numerous standard techniques known to the skilled worker for incorporating, affixing, and/or conjugating various detection promoting agents to proteins or proteinaceous components of molecules, especially to immunoglobulins and immunoglobulin-derived domains.

There are numerous detection promoting agents known to the skilled worker, such as isotopes, dyes, colorimetric agents, contrast enhancing agents, fluorescent agents, bioluminescent agents, and magnetic agents, which can be operably linked to the polypeptides or cell-targeting molecules of the invention for information gathering methods, such as for diagnostic and/or prognostic applications to diseases, disorders, or conditions of an organism (see e.g. Cai W et al., *J Nucl Med* 48: 304-10 (2007); Nayak T, Brechbiel M, *Bioconjug Chem* 20: 825-41 (2009); Paudyal P et al., *Oncol Rep* 22: 115-9 (2009); Qiao J et al., *PLoS ONE* 6: e18103 (2011); Sano K et al., *Breast Cancer Res* 14: R61 (2012)). These agents may be associated with, linked to, and/or incorporated within the polypeptide or cell-targeting molecule of the invention at any suitable position. For example, the linkage or incorporation of the detection promoting agent may be via an amino acid residue(s) of a molecule of the present invention or via some type of linkage known in the art, including via linkers and/or chelators. The incorporation of the agent is in such a way to enable the detection of the presence of the diagnostic composition in a screen, assay, diagnostic procedure, and/or imaging technique.

Similarly, there are numerous imaging approaches known to the skilled worker, such as non-invasive in vivo imaging techniques commonly used in the medical arena, for example: computed tomography imaging (CT scanning), optical imaging (including direct, fluorescent, and bioluminescent imaging), magnetic resonance imaging (MRI), positron emission tomography (PET), single-photon emission computed tomography (SPECT), ultrasound, and x-ray computed tomography imaging.

VIII. Production or Manufacture of Pharmaceutical and/or Diagnostic Compositions Comprising Cell-Targeting Molecules of the Present Invention Pharmaceutically acceptable salts or solvates of any of the Shiga toxin effector polypeptides and cell-targeting molecules of the present invention are within the scope of the present invention.

The term "solvate" in the context of the present invention refers to a complex of defined stoichiometry formed between a solute (in casu, a proteinaceous compound or pharmaceutically acceptable salt thereof according to the invention) and a solvent. The solvent in this connection may, for example, be water, ethanol or another pharmaceutically acceptable, typically small-molecular organic species, such as, but not limited to, acetic acid or lactic acid. When the solvent in question is water, such a solvate is normally referred to as a hydrate.

Polypeptides and proteins of the present invention, or salts thereof, may be formulated as pharmaceutical compositions prepared for storage or administration, which typically comprise a therapeutically effective amount of a molecule of the present invention, or a salt thereof, in a pharmaceutically acceptable carrier. The term "pharmaceutically acceptable carrier" includes any of the standard pharmaceutical carriers. Pharmaceutically acceptable carriers for therapeutic molecule use are well known in the pharmaceutical art, and are described, for example, in *Remington's Pharmaceutical Sciences* (Mack Publishing Co. (A. Gennaro, ed., 1985). As used herein, "pharmaceutically acceptable carrier" includes any and all physiologically acceptable, i.e. compatible, solvents, dispersion media, coatings, antimicrobial agents, isotonic, and absorption delaying agents, and the like. Pharmaceutically acceptable carriers or diluents include those used in formulations suitable for oral, rectal, nasal or parenteral (including subcutaneous, intramuscular, intravenous, intradermal, and transdermal) administration. Exemplary pharmaceutically acceptable carriers include sterile aqueous solutions or dispersions and sterile powders for the extemporaneous preparation of sterile injectable solutions or dispersions. Examples of suitable aqueous and nonaqueous carriers that may be employed in the pharmaceutical compositions of the invention include water, ethanol, polyols (such as glycerol, propylene glycol, polyethylene glycol, and the like), and suitable mixtures thereof, vegetable oils, such as olive oil, and injectable organic esters, such as ethyloleate. Proper fluidity can be maintained, for example, by the use of coating materials, such as lecithin, by the maintenance of the required particle size in the case of dispersions, and by the use of surfactants. In certain embodiments, the carrier is suitable for intravenous, intramuscular, subcutaneous, parenteral, spinal or epidermal administration (e.g. by injection or infusion). Depending on selected route of administration, the protein or other pharmaceutical component may be coated in a material intended to protect the compound from the action of low pH and other natural inactivating conditions to which the active protein may encounter when administered to a patient by a particular route of administration.

The formulations of the pharmaceutical compositions of the invention may conveniently be presented in unit dosage form and may be prepared by any of the methods well known in the art of pharmacy. In such form, the composition is divided into unit doses containing appropriate quantities of the active component. The unit dosage form can be a packaged preparation, the package containing discrete quantities of the preparations, for example, packeted tablets, capsules, and powders in vials or ampoules. The unit dosage form can also be a capsule, cachet, or tablet itself, or it can be the appropriate number of any of these packaged forms. It may be provided in single dose injectable form, for example in the form of a pen. Compositions may be formulated for any suitable route and means of administration. Subcutaneous or transdermal modes of administration may be particularly suitable for therapeutic proteins described herein.

The pharmaceutical compositions of the present invention may also contain adjuvants such as preservatives, wetting agents, emulsifying agents and dispersing agents. Preventing the presence of microorganisms may be ensured both by sterilization procedures, and by the inclusion of various antibacterial and antifungal agents, for example, paraben, chlorobutanol, phenol sorbic acid, and the like. Isotonic agents, such as sugars, sodium chloride, and the like into the compositions, may also be desirable. In addition, prolonged absorption of the injectable pharmaceutical form may be brought about by the inclusion of agents which delay absorption such as, aluminum monostearate and gelatin.

A pharmaceutical composition of the present invention also optionally includes a pharmaceutically acceptable antioxidant. Exemplary pharmaceutically acceptable antioxidants are water soluble antioxidants such as ascorbic acid, cysteine hydrochloride, sodium bisulfate, sodium metabisulfite, sodium sulfite and the like; oil-soluble antioxidants, such as ascorbyl palmitate, butylated hydroxyanisole (BHA), butylated hydroxytoluene (BHT), lecithin, propylgallate, alpha-tocopherol, and the like; and metal chelating agents, such as citric acid, ethylenediamine tetraacetic acid (EDTA), sorbitol, tartaric acid, phosphoric acid, and the like.

In another aspect, the present invention provides pharmaceutical compositions comprising one or a combination of different polypeptides and/or cell-targeting molecules of the invention, or an ester, salt or amide of any of the foregoing, and at least one pharmaceutically acceptable carrier.

Therapeutic compositions are typically sterile and stable under the conditions of manufacture and storage. The composition may be formulated as a solution, microemulsion, liposome, or other ordered structure suitable to high drug concentration. The carrier may be a solvent or dispersion medium containing, for example, water, alcohol such as ethanol, polyol (e.g., glycerol, propylene glycol, and liquid polyethylene glycol), or any suitable mixtures. The proper fluidity may be maintained, for example, by the use of a coating such as lecithin, by the maintenance of the required particle size in the case of dispersion and by use of surfactants according to formulation chemistry well known in the art. In certain embodiments, isotonic agents, e.g., sugars and polyalcohols such as mannitol, sorbitol, or sodium chloride, may be desirable in the composition. Prolonged absorption of injectable compositions may be brought about by including in the composition an agent that delays absorption for example, monostearate salts and gelatin.

Solutions or suspensions used for intradermal or subcutaneous application typically include one or more of: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates; and tonicity adjusting agents such as, e.g., sodium chloride or dextrose. The pH can be adjusted with acids or bases, such as hydrochloric acid or sodium hydroxide, or buffers with citrate, phosphate, acetate and the like. Such preparations may be enclosed in ampoules, disposable syringes or multiple dose vials made of glass or plastic.

Sterile injectable solutions may be prepared by incorporating a polypeptide or cell-targeting molecule of the invention in the required amount in an appropriate solvent with one or a combination of ingredients described above, as required, followed by sterilization microfiltration. Dispersions may be prepared by incorporating the active compound into a sterile vehicle that contains a dispersion medium and other ingredients, such as those described above. In the case of sterile powders for the preparation of sterile injectable solutions, the methods of preparation are vacuum drying and freeze-drying (lyophilization) that yield a powder of the active ingredient in addition to any additional desired ingredient from a sterile-filtered solution thereof.

When a therapeutically effective amount of a polypeptide and/or cell-targeting molecule of the invention is designed to be administered by, e.g. intravenous, cutaneous or subcutaneous injection, the binding agent will be in the form of a pyrogen-free, parenterally acceptable aqueous solution. Methods for preparing parenterally acceptable protein solutions, taking into consideration appropriate pH, isotonicity, stability, and the like, are within the skill in the art. A preferred pharmaceutical composition for intravenous, cutaneous, or subcutaneous injection will contain, in addition to binding agents, an isotonic vehicle such as sodium chloride injection, Ringer's injection, dextrose injection, dextrose and sodium chloride injection, lactated Ringer's injection, or other vehicle as known in the art. A pharmaceutical composition of the present invention may also contain stabilizers, preservatives, buffers, antioxidants, or other additives well known to those of skill in the art.

As described elsewhere herein, a polypeptide and/or cell-targeting molecule of the present invention may be prepared with carriers that will protect the active therapeutic agent against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art (see e.g. *Sustained and Controlled Release Drug Delivery Systems* (Robinson J, ed., Marcel Dekker, Inc., NY, U.S., 1978)).

In certain embodiments, the composition of the present invention (e.g. a pharmaceutical and/or diagnostic composition) may be formulated to ensure a desired in vivo distribution of a cell-targeting molecule of the present invention. For example, the blood-brain barrier excludes many large and/or hydrophilic compounds. To target a therapeutic molecule or composition of the present invention to a particular in vivo location, they can be formulated, for example, in liposomes which may comprise one or more moieties that are selectively transported into specific cells or organs, thus enhancing targeted drug delivery. Exemplary targeting moieties include folate or biotin; mannosides; antibodies; surfactant protein A receptor; p120 catenin and the like.

Pharmaceutical compositions include parenteral formulations designed to be used as implants or particulate systems. Examples of implants are depot formulations composed of polymeric or hydrophobic components such as emulsions, ion exchange resins, and soluble salt solutions. Examples of particulate systems are microspheres, microparticles, nanocapsules, nanospheres, and nanoparticles (see e.g. Honda M et al., *Int J Nanomedicine* 8: 495-503 (2013); Sharma A et al., *Biomed Res Int* 2013: 960821 (2013); Ramishetti S, Huang L, *Ther Deliv* 3: 1429-45 (2012)). Controlled release formulations may be prepared using polymers sensitive to ions, such as, e.g. liposomes, polaxamer 407, and hydroxyapatite.

IX. Polynucleotides, Expression Vectors, and Host Cells of the Present Invention Beyond the polypeptides and cell-targeting molecules of the present invention, the polynucleotides that encode the polypeptides and cell-targeting molecules of the invention, or functional portions thereof, are also encompassed within the scope of the present invention. The term "polynucleotide" is equivalent to the term "nucleic acid," each of which includes one or more of: polymers of deoxyribonucleic acids (DNAs), polymers of ribonucleic acids (RNAs), analogs of these DNAs or RNAs generated using nucleotide analogs, and derivatives, fragments and homologs thereof. The polynucleotide of the present invention may be single-, double-, or triple-stranded. Such polynucleotides are specifically disclosed to include all polynucleotides capable of encoding an exemplary protein, for example, taking into account the wobble known to be tolerated in the third position of RNA codons, yet encoding for the same amino acid as a different RNA codon (see Stothard P, *Biotechniques* 28: 1102-4 (2000)).

In one aspect, the present invention provides polynucleotides which encode a Shiga toxin effector polypeptide and/or cell-targeting molecule of the present invention, or a fragment or derivative thereof. The polynucleotides may include, e.g., a nucleic acid sequence encoding a polypeptide at least 50%, 55%, 60%, 65%, 70%, 75%, 80%, 85%, 90%, 95%, 99% or more, identical to a polypeptide comprising one of the amino acid sequences of a polypeptide or cell-targeting molecule of the present invention. The invention also includes polynucleotides comprising nucleotide sequences that hybridize under stringent conditions to a polynucleotide which encodes Shiga toxin effector polypeptide and/or cell-targeting molecule of the invention, or a fragment or derivative thereof, or the antisense or complement of any such sequence.

Derivatives or analogs of the molecules of the present invention (e.g., Shiga toxin effector polypeptides of the present invention and cell-targeting molecules comprising the same) include, inter alia, polynucleotide (or polypeptide) molecules having regions that are substantially homologous to the polynucleotides (or Shiga toxin effector polypeptides and cell-targeting molecules of the present invention), e.g. by at least about 45%, 50%, 70%, 80%, 95%, 98%, or even 99% identity (with a preferred identity of 80-99%) over a polynucleotide (or polypeptide) sequence of the same size or when compared to an aligned sequence in which the alignment is done by a computer homology program known in the art. An exemplary program is the GAP program (Wisconsin Sequence Analysis Package, Version 8 for UNIX, Genetics Computer Group, University Research Park, Madison, Wis., U.S.) using the default settings, which uses the algorithm of Smith T, Waterman M, *Adv Appl Math* 2: 482-9 (1981). Also included are polynucleotides capable of hybridizing to the complement of a sequence encoding the cell-targeting proteins of the invention under stringent conditions (see e.g. Ausubel F et al., *Current Protocols in Molecular Biology* (John Wiley & Sons, New York, N.Y., U.S., 1993)), and below. Stringent conditions are known to those skilled in the art and may be found, e.g., in *Current Protocols in Molecular Biology* (John Wiley & Sons, NY, U.S., Ch. Sec. 6.3.1-6.3.6 (1989)).

The present invention further provides expression vectors that comprise the polynucleotides within the scope of the present invention. The polynucleotides capable of encoding the Shiga toxin effector polypeptides and/or cell-targeting molecules of the invention may be inserted into known vectors, including bacterial plasmids, viral vectors and phage vectors, using material and methods well known in the art to produce expression vectors. Such expression vectors will include the polynucleotides necessary to support production of contemplated Shiga toxin effector polypeptides and/or cell-targeting molecules of the invention within any host cell of choice or cell-free expression systems (e.g. pTxb1 and pIVEX2.3). The specific polynucleotides comprising expression vectors for use with specific types of host cells or cell-free expression systems are well known to one of ordinary skill in the art, can be determined using routine experimentation, and/or may be purchased.

The term "expression vector," as used herein, refers to a polynucleotide, linear or circular, comprising one or more expression units. The term "expression unit" denotes a polynucleotide segment encoding a polypeptide of interest and capable of providing expression of the nucleic acid segment in a host cell. An expression unit typically comprises a transcription promoter, an open reading frame encoding the polypeptide of interest, and a transcription terminator, all in operable configuration. An expression vector contains one or more expression units. Thus, in the context of the present invention, an expression vector encoding a Shiga toxin effector polypeptide and/or cell-targeting molecule of the invention comprising a single polypeptide chain includes at least an expression unit for the single polypeptide chain, whereas a protein comprising, e.g. two or more polypeptide chains (e.g. one chain comprising a $V_L$ domain and a second chain comprising a $V_H$ domain linked to a toxin effector polypeptide) includes at least two expression units, one for each of the two polypeptide chains of the protein. For expression of multi-chain cell-targeting proteins of the invention, an expression unit for each polypeptide chain may also be separately contained on different expression vectors (e.g. expression may be achieved with a single host cell into which expression vectors for each polypeptide chain has been introduced).

Expression vectors capable of directing transient or stable expression of polypeptides and proteins are well known in the art. The expression vectors generally include, but are not limited to, one or more of the following: a heterologous signal sequence or peptide, an origin of replication, one or more marker genes, an enhancer element, a promoter, and a transcription termination sequence, each of which is well known in the art. Optional regulatory control sequences, integration sequences, and useful markers that can be employed are known in the art.

The term "host cell" refers to a cell which can support the replication or expression of the expression vector. Host cells may be prokaryotic cells, such as *E. coli* or eukaryotic cells (e.g. yeast, insect, amphibian, bird, or mammalian cells). Creation and isolation of host cell lines comprising a polynucleotide of the invention or capable of producing a polypeptide and/or cell-targeting molecule of the present invention can be accomplished using standard techniques known in the art.

Shiga toxin effector polypeptides and/or proteins within the scope of the present invention may be variants or derivatives of the polypeptides and molecules described herein that are produced by modifying the polynucleotide encoding a polypeptide and/or proteinaceous component of a cell-targeting molecule by altering one or more amino acids or deleting or inserting one or more amino acids that may render it more suitable to achieve desired properties, such as more optimal expression by a host cell.

X. Molecules of the Present Invention Immobilized on Solid Substrates

Certain embodiments of the present invention include a molecule of the present invention (e.g. a Shiga toxin effector polypeptide, a cell-targeting molecule, fusion protein, or polynucleotide of the present invention), or any effector fragment thereof, immobilized on a solid substrate. Solid substrates contemplated herein include, but are not limited to, microbeads, nanoparticles, polymers, matrix materials, microarrays, microtiter plates, or any solid surface known in the art (see e.g. U.S. Pat. No. 7,771,955). In accordance with these embodiments, a molecule of the present invention may be covalently or non-covalently linked to a solid substrate, such as, e.g., a bead, particle, or plate, using techniques known to the skilled worker (see e.g. Jung Y et al., *Analyst* 133: 697-701 (2008)). Immobilized molecules of the invention may be used for screening applications using techniques known in the art (see e.g. Bradbury A et al., *Nat Biotechnol* 29: 245-54 (2011); Sutton C, *Br J Pharmacol* 166: 457-75 (2012); Diamante L et al., *Protein Eng Des Sel* 26: 713-24 (2013); Houlihan G et al., *J Immunol Methods* 405: 47-56 (2014)).

Non-limiting examples of solid substrates to which a molecule of the invention may be immobilized on include: microbeads, nanoparticles, polymers, nanopolymers, nanotubes, magnetic beads, paramagnetic beads, superparamagnetic beads, streptavidin coated beads, reverse-phase magnetic beads, carboxy terminated beads, hydrazine terminated beads, silica (sodium silica) beads and iminodiacetic acid (IDA)-modified beads, aldehyde-modified beads, epoxy-activated beads, diaminodipropylamine (DADPA)-modified beads (beads with primary amine surface group), biodegradable polymeric beads, polystyrene substrates, amino-polystyrene particles, carboxyl-polystyrene particles, epoxy-polystyrene particles, dimethylamino-polystyrene particles, hydroxy-polystyrene particles, colored particles, flow cytometry particles, sulfonate-polystyrene particles, nitrocellulose surfaces, reinforced nitrocellulose membranes, nylon membranes, glass surfaces, activated glass surfaces, activated quartz surfaces, polyvinylidene difluoride (PVDF) membranes, polyacrylamide-based substrates, poly-vinyl chloride substrates, poly-methyl methacrylate substrates, poly(dimethyl siloxane) substrates, and photopolymers which contain photoreactive species (such as nitrenes, carbenes, and ketyl radicals) capable of forming covalent linkages. Other examples of solid substrates to which a molecule of the invention may be immobilized on are commonly used in molecular display systems, such as, e.g., cellular surfaces, phages, and virus particles.

XI. Delivery Devices and Kits

In certain embodiments, the invention relates to a device comprising one or more compositions of matter of the present invention, such as a pharmaceutical composition or diagnostic composition, for delivery to a subject in need thereof. Thus, a delivery device comprising one or more compositions of the present invention can be used to administer to a patient a composition of matter of the present invention by various delivery methods, including: intravenous, subcutaneous, intramuscular or intraperitoneal injection; oral administration; transdermal administration; pulmonary or transmucosal administration; administration by implant, osmotic pump, cartridge or micro pump; or by other means recognized by a person of skill in the art.

Also within the scope of the present invention are kits comprising at least one composition of matter of the invention, and optionally, packaging and instructions for use. Kits may be useful for drug administration and/or diagnostic information gathering. A kit of the invention may optionally comprise at least one additional reagent (e.g., standards, markers and the like). Kits typically include a label indicating the intended use of the contents of the kit. The kit may further comprise reagents and other tools for detecting a cell type (e.g. a tumor cell) in a sample or in a subject, or for diagnosing whether a patient belongs to a group that responds to a therapeutic strategy which makes use of a compound, composition, or related method of the present invention, e.g., such as a method described herein.

XII. Methods for Using Cell-Targeting Molecules of the Present Invention and/or Pharmaceutical and/or Diagnostic Compositions Thereof.

Generally, it is an object of the present invention to provide pharmacologically active agents, as well as compositions comprising the same, that can be used in the prevention and/or treatment of diseases, disorders, and conditions, such as certain cancers, tumors, growth abnormalities, immune disorders, or further pathological conditions mentioned herein. Accordingly, the present invention provides methods of using the polypeptides, cell-targeting molecules, and pharmaceutical compositions of the invention for the targeted killing of cells, for delivering additional exogenous materials into targeted cells, for labeling of the interiors of targeted cells, for collecting diagnostic information, for the delivering of T-cell epitopes to the MHC class I presentation pathway of target cells, and for treating diseases, disorders, and conditions as described herein. For example, the methods of the present invention may be used to prevent or treat cancers, cancer initiation, tumor initiation, metastasis, and/or disease reoccurrence.

In particular, it is an object of the invention to provide such pharmacologically active agents, compositions, and/or methods that have certain advantages compared to the agents, compositions, and/or methods that are currently known in the art. Accordingly, the present invention provides methods of using Shiga toxin effector polypeptides and cell-targeting molecules with specified protein sequences and pharmaceutical compositions thereof. For example, any of the amino acid sequences in SEQ ID NOs: 6-354 and 370-513 may be specifically utilized as a component of the cell-targeting molecule used in the following methods or any method for using a cell-targeting molecule known to the skilled worker, such as, e.g., various methods described in WO 2014/164680, WO 2014/164693, WO 2015/138435, WO 2015/138452, WO 2015/113005, WO 2015/113007, WO 2015/191764, US20150259428, 62/168,758, 62/168,759, 62/168,760, 62/168,761, 62/168,762, 62/168,763, and PCT/US2016/016580.

The present invention provides methods of killing a cell comprising the step of contacting the cell, either in vitro or in vivo, with a Shiga toxin effector polypeptide, cell-targeting molecule, or pharmaceutical composition of the present invention. The Shiga toxin effector polypeptides, cell-targeting molecules, and pharmaceutical compositions of the present invention can be used to kill a specific cell type upon contacting a cell or cells with one of the claimed compositions of matter. In certain embodiments, a cell-targeting molecule or pharmaceutical composition of the present invention can be used to kill specific cell types in a mixture of different cell types, such as mixtures comprising cancer cells, infected cells, and/or hematological cells. In certain embodiments, a cell-targeting molecule, or pharmaceutical composition of the present invention can be used to kill cancer cells in a mixture of different cell types. In certain embodiments, a cytotoxic Shiga cell-targeting molecule, or pharmaceutical composition of the present invention can be used to kill specific cell types in a mixture of different cell types, such as pre-transplantation tissues. In certain embodiments, a Shiga toxin effector polypeptide, cell-targeting molecule, or pharmaceutical composition of the present invention can be used to kill specific cell types in a mixture of cell types, such as pre-administration tissue material for therapeutic purposes. In certain embodiments, a cell-targeting molecule or pharmaceutical composition of the present invention can be used to selectively kill cells infected by viruses or microorganisms, or otherwise selectively kill cells expressing a particular extracellular target biomolecule, such as a cell surface biomolecule. The Shiga toxin effector polypeptides, cell-targeting molecules, and pharmaceutical compositions of the present invention have varied applications, including, e.g., uses in depleting unwanted cell types from tissues either in vitro or in vivo, uses in modulating immune responses to treat graft versus host, uses as antiviral agents, uses as anti-parasitic agents, and uses in purging transplantation tissues of unwanted cell types.

In certain embodiments, certain Shiga toxin effector polypeptides, cell-targeting molecules, and pharmaceutical compositions of the present invention, alone or in combination with other compounds or pharmaceutical compositions, can show potent cell-kill activity when administered to a population of cells, in vitro or in vivo in a subject such as in a patient in need of treatment. By targeting the delivery of enzymatically active Shiga toxin A Subunit effector polypeptides and/or T-cell epitopes using high-affinity binding regions to specific cell types, cell-kill activities can be restricted to specifically and selectively killing certain cell types within an organism, such as certain cancer cells, neoplastic cells, malignant cells, non-malignant tumor cells, and/or infected cells.

The present invention provides a method of killing a cell in a patient in need thereof, the method comprising the step of administering to the patient at least one cell-targeting molecule of the present invention or a pharmaceutical composition thereof.

In certain embodiments, the cell-targeting molecule of the present invention or pharmaceutical compositions thereof can be used to kill a cancer cell in a patient by targeting an extracellular biomolecule found physically coupled with a cancer or tumor cell. The terms "cancer cell" or "cancerous cell" refers to various neoplastic cells which grow and divide in an abnormally accelerated and/or unregulated fashion and will be clear to the skilled person. The term "tumor cell" includes both malignant and non-malignant cells. Generally, cancers and/or tumors can be defined as diseases, disorders, or conditions that are amenable to treatment and/or prevention. The cancers and tumors (either malignant or non-malignant) which are comprised of cancer cells and/or tumor cells which may benefit from methods and compositions of the invention will be clear to the skilled person. Neoplastic cells are often associated with one or more of the following: unregulated growth, lack of differentiation, local tissue invasion, angiogenesis, and metastasis. The diseases, disorders, and conditions resulting from cancers and/or tumors (either malignant or non-malignant) which may benefit from the methods and compositions of the present invention targeting certain cancer cells and/or tumor cells will be clear to the skilled person.

Certain embodiments of the cell-targeting molecules and compositions of the present invention may be used to kill cancer stem cells, tumor stem cells, pre-malignant cancer-initiating cells, and tumor-initiating cells, which commonly are slow dividing and resistant to cancer therapies like chemotherapy and radiation. For example, acute myeloid leukemias (AMLs) may be treated with the present invention by killing AML stem cells and/or dormant AML progenitor cells (see e.g. Shlush L et al., *Blood* 120: 603-12 (2012)). Cancer stem cells often overexpress cell surface targets, such as, e.g., CD44, CD200, and others listed herein, which can be targets of certain binding regions of certain embodiments of the cell-targeting molecules of the present invention (see e.g. Kawasaki B et al., *Biochem Biophys Res Commun* 364:778-82 (2007); Reim F et al., *Cancer Res* 69: 8058-66 (2009)).

Because of the Shiga toxin A Subunit based mechanism of action, compositions of matter of the present invention may be more effectively used in methods involving their combination with, or in complementary fashion with other therapies, such as, e.g., chemotherapies, immunotherapies, radiation, stem cell transplantation, and immune checkpoint inhibitors, and/or effective against chemoresistant/radiation-resistant and/or resting tumor cells/tumor initiating cells/stem cells. Similarly, compositions of matter of the present invention may be more effectively used in methods involving in combination with other cell-targeted therapies targeting other than the same epitope on, non-overlapping, or different targets for the same disease disorder or condition.

Certain embodiments of the cell-targeting molecules of the present invention, or pharmaceutical compositions thereof, can be used to kill an immune cell (whether healthy or malignant) in a patient by targeting an extracellular biomolecule found physically coupled with an immune cell.

It is within the scope of the present invention to utilize a cell-targeting molecule of the present invention, or pharmaceutical composition thereof, for the purposes of purging patient cell populations (e.g. bone marrow) of malignant, neoplastic, or otherwise unwanted T-cells and/or B-cells and then reinfusing the T-cell and/or B-cells depleted material into the patient (see e.g. van Heeckeren W et al., *Br J Haematol* 132: 42-55 (2006); (see e.g. Alpdogan O, van den Brink M, *Semin Oncol* 39: 629-42 (2012)).

It is within the scope of the present invention to utilize the cell-targeting molecule of the present invention, or pharmaceutical composition thereof, for the purposes of ex vivo depletion of T cells and/or B-cells from isolated cell populations removed from a patient. In one non-limiting example, the cell-targeting molecule of the invention can be used in a method for prophylaxis of organ and/or tissue transplant rejection wherein the donor organ or tissue is perfused prior to transplant with a cytotoxic, cell-targeting molecule of the invention or a pharmaceutical composition thereof in order to purge the organ of donor T-cells and/or B-cells (see e.g. Alpdogan O, van den Brink M, *Semin Oncol* 39: 629-42 (2012)).

It is also within the scope of the present invention to utilize the cell-targeting molecule of the invention, or pharmaceutical composition thereof, for the purposes of depleting T-cells and/or B-cells from a donor cell population as a prophylaxis against graft-versus-host disease, and induction of tolerance, in a patient to undergo a bone marrow and or stem cell transplant (see e.g. van Heeckeren W et al., *Br J Haematol* 132: 42-55 (2006); (see e.g. Alpdogan O, van den Brink M, *Semin Oncol* 39: 629-42 (2012)).

In certain embodiments of the Shiga toxin effector polypeptide or cell-targeting molecule of the present invention, or pharmaceutical compositions thereof, can be used to kill an infected cell in a patient by targeting an extracellular biomolecule found physically coupled with an infected cell.

In certain embodiments of the cell-targeting molecules of the present invention, or pharmaceutical compositions thereof, can be used to "seed" a locus within a chordate with non-self, T-cell epitope-peptide presenting cells in order to activate the immune system to enhance policing of the locus. In certain further embodiments of this "seeding" method of the present invention, the locus is a tumor mass or infected tissue site. In preferred embodiments of this "seeding" method of the present invention, the non-self, T-cell epitope-peptide is selected from the group consisting of: peptides not already presented by the target cells of the cell-targeting molecule, peptides not present within any protein expressed by the target cell, peptides not present within the proteome or transcriptome of the target cell, peptides not present in the extracellular microenvironment of the site to be seeded, and peptides not present in the tumor mass or infect tissue site to be targeting.

This "seeding" method functions to label one or more target cells within a chordate with one or more MHC class I presented T-cell epitopes for recognition by effector T-cells and activation of downstream immune responses. By exploiting the cell internalizing, intracellularly routing, and T-cell epitope delivering functions of the cell-targeting molecules of the present invention, the target cells which display the delivered T-cell epitope are harnessed to induce recognition of the presenting target cell by host T-cells and induction of further immune responses including target-cell-killing by CTLs. This "seeding" method of using a cell-targeting molecule of the present invention can provide a temporary vaccination-effect by inducing adaptive immune responses to attack the cells within the seeded microenvironment, such as, e.g. a tumor mass or infected tissue site, whether presenting a cell-targeting molecule-delivered T-cell epitope(s) or not. This "seeding" method may also induce the breaking of immuno-tolerance to a target cell population, a tumor mass, and/or infected tissue site within a chordate.

Certain methods of the present invention involving the seeding of a locus within a chordate with one or more antigenic and/or immunogenic epitopes may be combined with the administration of immunologic adjuvants, whether administered locally or systemically, to stimulate the immune response to certain antigens, such as, e.g., the co-administration of a composition of the present invention with one or more immunologic adjuvants like a cytokine, bacterial product, or plant saponin. Other examples of immunologic adjuvants which may be suitable for use in the methods of the present invention include aluminum salts and oils, such as, e.g., alums, aluminum hydroxide, mineral oils, squalene, paraffin oils, peanut oils, and thimerosal.

Additionally, the present invention provides a method of treating a disease, disorder, or condition in a patient comprising the step of administering to a patient in need thereof a therapeutically effective amount of at least one of the cell-targeting molecules of the present invention, or a pharmaceutical composition thereof. Contemplated diseases, disorders, and conditions that can be treated using this method include cancers, malignant tumors, non-malignant tumors, growth abnormalities, immune disorders, and microbial infections. Administration of a "therapeutically effective dosage" of a composition of the present invention can result in a decrease in severity of disease symptoms, an increase in frequency and duration of disease symptom-free periods, or a prevention of impairment or disability due to the disease affliction.

The therapeutically effective amount of a composition of the present invention will depend on the route of administration, the type of organism being treated, and the physical characteristics of the specific patient under consideration. These factors and their relationship to determining this amount are well known to skilled practitioners in the medical arts. This amount and the method of administration can be tailored to achieve optimal efficacy, and may depend on such factors as weight, diet, concurrent medication and other factors, well known to those skilled in the medical arts. The dosage sizes and dosing regimen most appropriate for human use may be guided by the results obtained by the present invention, and may be confirmed in properly designed clinical trials. An effective dosage and treatment protocol may be determined by conventional means, starting with a low dose in laboratory animals and then increasing the dosage while monitoring the effects, and systematically varying the dosage regimen as well. Numerous factors may be taken into consideration by a clinician when determining an optimal dosage for a given subject. Such considerations are known to the skilled person.

An acceptable route of administration may refer to any administration pathway known in the art, including but not limited to aerosol, enteral, nasal, ophthalmic, oral, parenteral, rectal, vaginal, or transdermal (e.g. topical administration of a cream, gel or ointment, or by means of a transdermal patch). "Parenteral administration" is typically associated with injection at or in communication with the intended site of action, including infraorbital, infusion, intraarterial, intracapsular, intracardiac, intradermal, intramuscular, intraperitoneal, intrapulmonary, intraspinal, intrasternal, intrathecal, intrauterine, intravenous, subarachnoid, subcapsular, subcutaneous, transmucosal, or transtracheal administration.

For administration of a pharmaceutical composition of the present invention, the dosage range will generally be from about 0.001 to 10 milligrams per kilogram (mg/kg), and more, usually 0.001 to 0.5 mg/kg, of the subject's body weight. Exemplary dosages may be 0.01 mg/kg body weight, 0.03 mg/kg body weight, 0.07 mg/kg body weight, 0.9 mg/kg body weight or 0.1 mg/kg body weight or within the range of 0.01 to 0.1 mg/kg. An exemplary treatment regime is a once or twice daily administration, or a once or twice weekly administration, once every two weeks, once every three weeks, once every four weeks, once a month, once every two or three months or once every three to 6 months. Dosages may be selected and readjusted by the skilled health care professional as required to maximize therapeutic benefit for a particular patient.

Pharmaceutical compositions of the present invention will typically be administered to the same patient on multiple occasions. Intervals between single dosages can be, for example, two to five days, weekly, monthly, every two or three months, every six months, or yearly. Intervals between administrations can also be irregular, based on regulating blood levels or other markers in the subject or patient. Dosage regimens for a composition of the present invention include intravenous administration of 1 mg/kg body weight or 3 mg/kg body weight with the composition administered every two to four weeks for six dosages, then every three months at 3 mg/kg body weight or 1 mg/kg body weight.

A pharmaceutical composition of the present invention may be administered via one or more routes of administration, using one or more of a variety of methods known in the art. As will be appreciated by the skilled worker, the route and/or mode of administration will vary depending upon the desired results. Routes of administration for cell-targeting molecules and pharmaceutical compositions of the present invention include, e.g. intravenous, intramuscular, intradermal, intraperitoneal, subcutaneous, spinal, or other parenteral routes of administration, for example by injection or infusion. For other embodiments, a cell-targeting molecule or pharmaceutical composition of the invention may be administered by a non-parenteral route, such as a topical, epidermal or mucosal route of administration, for example, intranasally, orally, vaginally, rectally, sublingually, or topically.

Therapeutic cell-targeting molecules or pharmaceutical compositions of the present invention may be administered with one or more of a variety of medical devices known in the art. For example, in one embodiment, a pharmaceutical composition of the invention may be administered with a needleless hypodermic injection device. Examples of well-known implants and modules useful in the present invention are in the art, including e.g., implantable micro-infusion pumps for controlled rate delivery; devices for administering through the skin; infusion pumps for delivery at a precise infusion rate; variable flow implantable infusion devices for continuous drug delivery; and osmotic drug delivery systems. These and other such implants, delivery systems, and modules are known to those skilled in the art.

The cell-targeting molecule or pharmaceutical composition of the present invention may be administered alone or in combination with one or more other therapeutic or diagnostic agents. A combination therapy may include a cell-targeting molecule of the present invention, or pharmaceutical composition thereof, combined with at least one other therapeutic agent selected based on the particular patient, disease or condition to be treated. Examples of other such agents include, inter alia, a cytotoxic, anti-cancer or chemotherapeutic agent, an anti-inflammatory or anti-proliferative agent, an antimicrobial or antiviral agent, growth factors, cytokines, an analgesic, a therapeutically active small molecule or polypeptide, a single chain antibody, a classical antibody or fragment thereof, or a nucleic acid molecule which modulates one or more signaling pathways, and similar modulating therapeutic molecules which may complement or otherwise be beneficial in a therapeutic or prophylactic treatment regimen.

Treatment of a patient with cell-targeting molecule or pharmaceutical composition of the present invention preferably leads to cell death of targeted cells and/or the inhibition of growth of targeted cells. As such, cytotoxic, cell-targeting molecules of the present invention, and pharmaceutical compositions comprising them, will be useful in methods for treating a variety of pathological disorders in which killing or depleting target cells may be beneficial, such as, inter alia, cancer, tumors, other growth abnormalities, immune disorders, and infected cells. The present invention provides methods for suppressing cell proliferation, and treating cell disorders, including neoplasia, overactive B-cells, and overactive T-cells.

In certain embodiments, the cell-targeting molecules and pharmaceutical compositions of the present invention can be used to treat or prevent cancers, tumors (malignant and non-malignant), growth abnormalities, immune disorders, and microbial infections. In a further aspect, the above ex vivo method can be combined with the above in vivo method to provide methods of treating or preventing rejection in bone marrow transplant recipients, and for achieving immunological tolerance.

In certain embodiments, the present invention provides methods for treating malignancies or neoplasms and other blood cell associated cancers in a mammalian subject, such as a human, the method comprising the step of administering to a subject in need thereof a therapeutically effective amount of a cytotoxic cell-targeting molecule or pharmaceutical composition of the present invention.

The cell-targeting molecules and pharmaceutical compositions of the present invention have varied applications, including, e.g., uses in removing unwanted T-cells, uses in modulating immune responses to treat graft versus host, uses as antiviral agents, uses as antimicrobial agents, and uses in purging transplantation tissues of unwanted cell types. The cell-targeting molecules and pharmaceutical compositions of the present invention are commonly anti-neoplastic agents-meaning they are capable of treating and/or preventing the development, maturation, or spread of neoplastic or malignant cells by inhibiting the growth and/or causing the death of cancer or tumor cells.

In certain embodiments, the cell-targeting molecule or pharmaceutical composition of the present invention is used to treat a B-cell-, plasma cell- or antibody-mediated disease or disorder, such as for example leukemia, lymphoma, myeloma, Human Immunodeficiency Virus-related diseases, amyloidosis, hemolytic uremic syndrome, polyarteritis, septic shock, Crohn's Disease, rheumatoid arthritis, ankylosing spondylitis, psoriatic arthritis, ulcerative colitis, psoriasis, asthma, Sjörgren's syndrome, graft-versus-host disease, graft rejection, diabetes, vasculitis, scleroderma, and systemic lupus erythematosus.

In another aspect, certain embodiments of the cell-targeting molecules and pharmaceutical compositions of the present invention are antimicrobial agents-meaning they are capable of treating and/or preventing the acquisition, development, or consequences of microbiological pathogenic infections, such as caused by viruses, bacteria, fungi, prions, or protozoans.

It is within the scope of the present invention to provide a prophylaxis or treatment for diseases or conditions mediated by T-cells or B-cells by administering the cell-targeting molecule the present invention, or a pharmaceutical composition thereof, to a patient for the purpose of killing T-cells or B-cells in the patient. This usage is compatible with preparing or conditioning a patient for bone marrow transplantation, stem cell transplantation, tissue transplantation, or organ transplantation, regardless of the source of the transplanted material, e.g. human or non-human sources.

It is within the scope of the present invention to provide a bone marrow recipient for prophylaxis or treatment of host-versus-graft disease via the targeted cell-killing of host T-cells using a cytotoxic cell-targeting molecule or pharmaceutical composition of the present invention.

Certain embodiments of the cell-targeting molecules and pharmaceutical compositions of the present invention can be utilized in a method of treating cancer comprising administering to a patient, in need thereof, a therapeutically effective amount of a cell-targeting molecule and/or pharmaceutical composition of the present invention. In certain embodiments of the methods of the present invention, the cancer being treated is selected from the group consisting of: bone cancer (such as multiple myeloma or Ewing's sarcoma), breast cancer, central/peripheral nervous system cancer (such as brain cancer, neurofibromatosis, or glioblastoma), gastrointestinal cancer (such as stomach cancer or colorectal cancer), germ cell cancer (such as ovarian cancers and testicular cancers, glandular cancer (such as pancreatic cancer, parathyroid cancer, pheochromocytoma, salivary gland cancer, or thyroid cancer), head-neck cancer (such as nasopharyngeal cancer, oral cancer, or pharyngeal cancer), hematological cancers (such as leukemia, lymphoma, or myeloma), kidney-urinary tract cancer (such as renal cancer and bladder cancer), liver cancer, lung/pleura cancer (such as mesothelioma, small cell lung carcinoma, or non-small cell lung carcinoma), prostate cancer, sarcoma (such as angiosarcoma, fibrosarcoma, Kaposi's sarcoma, or synovial sarcoma), skin cancer (such as basal cell carcinoma, squamous cell carcinoma, or melanoma), and uterine cancer.

Certain embodiments of the cell-targeting molecules and pharmaceutical compositions of the present invention can be utilized in a method of treating an immune disorder comprising administering to a patient, in need thereof, a therapeutically effective amount of the cell-targeting molecules and/or pharmaceutical composition of the present invention. In certain embodiments of the methods of the present invention, the immune disorder is related to an inflammation associated with a disease selected from the group consisting of: amyloidosis, ankylosing spondylitis, asthma, Crohn's disease, diabetes, graft rejection, graft-vs.-host disease, Hashimoto's thyroiditis, hemolytic uremic syndrome, HIV-related diseases, lupus erythematosus, multiple sclerosis, polyarteritis, psoriasis, psoriatic arthritis, rheumatoid arthritis, scleroderma, septic shock, Sjörgren's syndrome, ulcerative colitis, and vasculitis.

Among certain embodiments of the present invention is using the Shiga toxin effector polypeptide or cell-targeting molecule of the present invention as a component of a pharmaceutical composition or medicament for the treatment or prevention of a cancer, tumor, other growth abnormality, immune disorder, and/or microbial infection. For example, immune disorders presenting on the skin of a patient may be treated with such a medicament in efforts to reduce inflammation. In another example, skin tumors may be treated with such a medicament in efforts to reduce tumor size or eliminate the tumor completely.

Certain cytotoxic cell-targeting molecules of the present invention, and compositions thereof, may be used in molecular neurosurgery applications such as immunolesioning and neuronal tracing (see, Wiley R, Lappi D, *Adv Drug Deliv Rev* 55: 1043-54 (2003), for review). For example, the targeting domain may be selected or derived from various ligands, such as neurotransmitters and neuropeptides, which target specific neuronal cell types by binding neuronal surface receptors, such as a neuronal circuit specific G-protein coupled receptor. Similarly, the targeting domain may be selected from or derived from antibodies that bind neuronal surface receptors. Because certain Shiga toxin effector polypeptides robustly direct their own retrograde axonal transport, certain cell-targeting molecules of the present invention may be used to kill a neuron(s) which expresses the extracellular target at a site of cytotoxic protein injection distant from the cell body (see Llewellyn-Smith I et al., *JNeurosci Methods* 103: 83-90 (2000)). These targeted cytotoxic molecules of the invention that specifically target neuronal cell types have uses in neuroscience research, such as for elucidating mechanisms of sensations (see e.g. Mishra S, Hoon M, *Science* 340: 968-71 (2013), and creating model systems of neurodegenerative diseases, such as Parkinson's and Alzheimer's (see e.g. Hamlin A et al., *PLoS One* e53472 (2013)).

Among certain embodiment of the present invention is a method of using a Shiga toxin effector polypeptide, cell-targeting molecule, pharmaceutical composition, and/or diagnostic composition of the present invention to label or detect the interiors of neoplastic cells and/or immune cell types. This method may be based on the ability of certain cell-targeting molecules of the present invention to enter specific cell types and route within cells via retrograde intracellular transport, to the interior compartments of specific cell types are labeled for detection. This can be performed on cells in situ within a patient or on cells and tissues removed from an organism, e.g. biopsy material.

Among certain embodiment of the present invention is a method of using a Shiga toxin effector polypeptide, cell-targeting molecule, pharmaceutical composition, and/or diagnostic composition of the present invention to detect the presence of a cell type for the purpose of information gathering regarding diseases, conditions and/or disorders. The method comprises contacting a cell with a diagnostically sufficient amount of a cell-targeting molecule of the present invention in order to detect the molecule by an assay or diagnostic technique. The phrase "diagnostically sufficient amount" refers to an amount that provides adequate detection and accurate measurement for information gathering purposes by the particular assay or diagnostic technique utilized. Generally, the diagnostically sufficient amount for whole organism in vivo diagnostic use will be a non-cumulative dose of between 0.001 to 10 milligrams of the detection promoting agent linked cell-targeting molecule of the invention per kg of subject per subject. Typically, the amount of Shiga toxin effector polypeptide or cell-targeting molecule of the invention used in these information gathering methods will be as low as possible provided that it is still a diagnostically sufficient amount. For example, for in vivo detection in an organism, the amount of Shiga toxin effector polypeptide, cell-targeting molecule, or pharmaceutical composition of the invention administered to a subject will be as low as feasibly possible.

The cell-type specific targeting of cell-targeting molecules of the present invention combined with detection promoting agents provides a way to detect and image cells physically coupled with an extracellular target biomolecule of a binding region of the molecule of the invention. Imaging of cells using the cell-targeting molecules of the present invention may be performed in vitro or in vivo by any suitable technique known in the art. Diagnostic information may be collected using various methods known in the art, including whole body imaging of an organism or using ex vivo samples taken from an organism. The term "sample" used herein refers to any number of things, but not limited to, fluids such as blood, urine, serum, lymph, saliva, anal secretions, vaginal secretions, and semen, and tissues obtained by biopsy procedures. For example, various detection promoting agents may be utilized for non-invasive in vivo tumor imaging by techniques such as magnetic resonance imaging (MRI), optical methods (such as direct, fluorescent, and bioluminescent imaging), positron emission tomography (PET), single-photon emission computed tomography (SPECT), ultrasound, x-ray computed tomography, and combinations of the aforementioned (see, Kaur S et al., *Cancer Lett* 315: 97-111 (2012), for review).

Among certain embodiment of the present invention is a method of using a Shiga toxin effector polypeptide, cell-targeting molecule, or pharmaceutical composition of the present invention in a diagnostic composition to label or detect the interiors of a hematologic cell, cancer cell, tumor cell, infected cell, and/or immune cell (see e.g., Koyama Y et al., *Clin Cancer Res* 13: 2936-45 (2007); Ogawa M et al., *Cancer Res* 69: 1268-72 (2009); Yang L et al., *Small* 5: 235-43 (2009)). Based on the ability of certain cell-targeting molecules of the invention to enter specific cell types and route within cells via retrograde intracellular transport, the interior compartments of specific cell types are labeled for detection. This can be performed on cells in situ within a patient or on cells and tissues removed from an organism, e.g. biopsy material.

Diagnostic compositions of the present invention may be used to characterize a disease, disorder, or condition as potentially treatable by a related pharmaceutical composition of the present invention. In certain compositions of matter of the present invention may be used to determine whether a patient belongs to a group that responds to a therapeutic strategy which makes use of a compound, composition or related method of the present invention as described herein or is well suited for using a delivery device of the invention.

Diagnostic compositions of the present invention may be used after a disease, e.g. a cancer, is detected in order to better characterize it, such as to monitor distant metastases, heterogeneity, and stage of cancer progression. The phenotypic assessment of disease disorder or infection can help prognostic and prediction during therapeutic decision making. In disease reoccurrence, certain methods of the invention may be used to determine if local or systemic problem.

Diagnostic compositions of the present invention may be used to assess responses to therapies regardless of the type of the type of therapy, e.g. small molecule drug, biological drug, or cell-based therapy. For example, certain embodiments of the diagnostics of the invention may be used to measure changes in tumor size, changes in antigen positive cell populations including number and distribution, or monitoring a different marker than the antigen targeted by a therapy already being administered to a patient (see Smith-Jones P et al., *Nat. Biotechnol* 22: 701-6 (2004); Evans M et al., *Proc. Natl. Acad. Sci. USA* 108: 9578-82 (2011)).

In certain embodiments of the method used to detect the presence of a cell type may be used to gather information regarding diseases, disorders, and conditions, such as, for example bone cancer (such as multiple myeloma or Ewing's sarcoma), breast cancer, central/peripheral nervous system cancer (such as brain cancer, neurofibromatosis, or glioblastoma), gastrointestinal cancer (such as stomach cancer or colorectal cancer), germ cell cancer (such as ovarian cancers and testicular cancers, glandular cancer (such as pancreatic cancer, parathyroid cancer, pheochromocytoma, salivary gland cancer, or thyroid cancer), head-neck cancer (such as nasopharyngeal cancer, oral cancer, or pharyngeal cancer), hematological cancers (such as leukemia, lymphoma, or myeloma), kidney-urinary tract cancer (such as renal cancer and bladder cancer), liver cancer, lung/pleura cancer (such as mesothelioma, small cell lung carcinoma, or non-small cell lung carcinoma), prostate cancer, sarcoma (such as angiosarcoma, fibrosarcoma, Kaposi's sarcoma, or synovial sarcoma), skin cancer (such as basal cell carcinoma, squamous cell carcinoma, or melanoma), uterine cancer, AIDS, amyloidosis, ankylosing spondylitis, asthma, autism, cardiogenesis, Crohn's disease, diabetes, erythematosus, gastritis, graft rejection, graft-versus-host disease, Grave's disease, Hashimoto's thyroiditis, hemolytic uremic syndrome, HIV-related diseases, lupus erythematosus, lymphoproliferative disorders (including post-transplant lymphoproliferative disorders), multiple sclerosis, myasthenia gravis, neuroinflammation, polyarteritis, psoriasis, psoriatic arthritis, rheumatoid arthritis, scleroderma, septic shock, Sjörgren's syndrome, systemic lupus erythematosus, ulcerative colitis, vasculitis, cell proliferation, inflammation, leukocyte activation, leukocyte adhesion, leukocyte chemotaxis, leukocyte maturation, leukocyte migration, neuronal differentiation, acute lymphoblastic leukemia (ALL), T acute lymphocytic leukemia/lymphoma (ALL), acute myelogenous leukemia, acute myeloid leukemia (AML), B-cell chronic lymphocytic leukemia (B-CLL), B-cell prolymphocytic lymphoma, Burkitt's lymphoma (BL), chronic lymphocytic leukemia (CLL), chronic myelogenous leukemia (CML-BP), chronic myeloid leukemia (CML), diffuse large B-cell lymphoma, follicular lymphoma, hairy cell leukemia (HCL), Hodgkin's Lymphoma (HL), intravascular large B-cell lymphoma, lymphomatoid granulomatosis, lymphoplasmacytic lymphoma, MALT lymphoma, mantle cell lymphoma, multiple myeloma (MM), natural killer cell leukemia, nodal marginal B-cell lymphoma, Non-Hodgkin's lymphoma (NHL), plasma cell leukemia, plasmacytoma, primary effusion lymphoma, pro-lymphocytic leukemia, promyelocytic leukemia, small lymphocytic lymphoma, splenic marginal zone lymphoma, T-cell lymphoma (TCL), heavy chain disease, monoclonal gammopathy, monoclonal immunoglobulin deposition disease, myelodusplastic syndromes (MDS), smoldering multiple myeloma, and Waldenstrom macroglobulinemia.

In certain embodiments, the Shiga toxin effector polypeptides and cell-targeting molecules of the present invention, or pharmaceutical compositions thereof, are used for both diagnosis and treatment, or for diagnosis alone. In some situations, it would be desirable to determine or verify the HLA variant(s) and/or HLA alleles expressed in the subject and/or diseased tissue from the subject, such as, e.g., a patient in need of treatment, before selecting a Shiga toxin effector polypeptide or cell-targeting molecule of the invention for use in treatment(s).

Any embodiment of the Shiga toxin effector polypeptide of the present invention and cell-targeting molecule of the present invention (e.g. embodiments of embodiment sets #1-11 in the Summary) may be used with each individual embodiment of the methods of the present invention.

The present invention is further illustrated by the following non-limiting examples of 1) Shiga toxin effector polypeptides of the present invention, 2) cell-targeting molecules of the present invention, and 3) cytotoxic, cell-targeting molecules of the present invention comprising the aforementioned polypeptides and capable of specifically targeting certain cell types.

Examples

The following examples demonstrate certain embodiments of the present invention. However, it is to be understood that these examples are for illustration purposes only and do not intend, nor should any be construed, to be wholly definitive as to conditions and scope of this invention. The experiments in the following examples were carried out using standard techniques, which are well known and routine to those of skill in the art, except where otherwise described.

The following examples describe several, exemplary, cytotoxic, Shiga toxin A Subunit derived polypeptide scaffolds comprising Shiga toxin effector polypeptides of the present invention. The Shiga toxin effector polypeptides in the Examples are de-immunized while retaining catalytic and/or cytotoxic activities.

The following examples also describe several, cytotoxic, cell-targeting molecules, each molecule comprising a Shiga toxin effector polypeptide linked, either directly or indirectly, to a cell-targeting binding region capable of binding an extracellular part of a target biomolecule physically associated with a cellular surface of a cell. Exemplary, cytotoxic, cell-targeting molecules described below bound to cell-surface, target biomolecules expressed by targeted, tumor cell-types and entered those targeted cells. The internalized, cell-targeting molecules effectively routed their Shiga toxin effector polypeptides to the cytosols of target cells where the Shiga toxin effector polypeptides inactivated ribosomes and subsequently caused the apoptotic death of the targeted cells. The exemplary cell-targeting molecules of the invention are able to effectively deliver immunogenic, T-cell epitopes to the MHC class I pathway of target cells.

Additionally, some of the exemplary cell-targeting molecules comprise protease-cleavage resistant, de-immunized, Shiga toxin effector polypeptides that exhibited improved in vivo immunogenicity profiles (reductions in antibody responses) as compared to parental cytotoxic molecules comprising a furin-cleavage resistant, Shiga toxin effector polypeptide that had not been further de-immunized by the disruption of additional, endogenous epitope regions. Furthermore, these exemplary, protease-cleavage resistant, de-immunized cell-targeting molecules exhibit improved in vivo tolerability as compared to related cell-targeting molecules comprising more protease-cleavage sensitive Shiga toxin effector polypeptide regions.

The Examples below describe certain, Shiga toxin effector polypeptides of the present invention and their properties. Certain Examples describe de-immunized, Shiga toxin effector polypeptides of the present invention that comprise embedded, heterologous, CD8+ T-cell epitopes. Certain Examples describe de-immunized, Shiga toxin effector polypeptides of the present invention that are furin-cleavage resistant. Certain Examples describe furin-cleavage resistant, de-immunized, Shiga toxin effector polypeptides of the present invention that comprise embedded, heterologous, CD8+ T-cell epitopes. Certain Examples describe furin-cleavage resistant, Shiga toxin effector polypeptides of the present invention that comprise embedded, heterologous, CD8+ T-cell epitopes with only minimal de-immunization. Furthermore, the Examples below describe certain, cell-targeting molecules of the present invention and their properties. Certain Examples describe cell-targeting molecules of the present invention wherein a Shiga toxin effector polypeptide component (1) is de-immunized; (2) is on or proximal to an amino-terminus of a polypeptide component of the cell-targeting molecule; (3) is furin-cleavage resistant; and/or (4) comprises an embedded or inserted T-cell epitope. Certain Examples describe cell-targeting molecules wherein a polypeptide component of the cell-targeting molecule comprises a carboxy-terminal, endoplasmic reticulum retention/retrieval signal motif.

Example 1. Identifying Endogenous, Epitope Regions in Shiga Toxin A Subunit Effector Polypeptides Polypeptide sequences of the A Subunits from multiple Shiga toxins of the Shiga toxin family were analyzed to identify putative, antigenic and/or immunogenic epitopes. This Example shows how antigenic and immunogenic epitopes can be identified in Shiga toxin A Subunits and related polypeptides (see also WO 2015/113005; WO 2015/113007). Computational methods were used to predict antigenic and/or immunogenic epitopes in various Shiga toxin A Subunits, including utilizing publicly available data regarding protein structures. Both B-cell epitopes and CD4+ T-cell epitopes with a potential to elicit immune responses were predicted in silico. Epitope predictions were validated empirically (see Example 2, infra; WO 2015/113005; WO 2015/113007).

Linear, B-cell epitopes were predicted for the mature A Subunit of Shiga-like toxin 1 (SLT-1A; SEQ ID NO:1) from the polypeptide sequence and 3D structural data of Shiga-Like Toxin Chain A (PDB ID: 1DM0_A) by ProImmune Inc. (Sarasota, Fla., U.S.) using their REVEAL® system.

In addition, B-cell epitopes were predicted in the polypeptide sequences of the A Subunits of Shiga toxin (StxA;

SEQ ID NO:2), Shiga-like toxin 1 (SLT-1A; SEQ ID NO:1), and Shiga-like toxin 2 (Stx2A; SEQ ID NO:3) using the BcePred webserver (Saha S, Raghava G, *Lecture Notes in Comput Sci* 3239: 197-204 (2004)), Bepipred Linear Epitope Prediction (Larsen J et al., *Immunome Res* 2: 2 (2006)), and ElliPro Antibody epitope prediction (Haste Andersen P et al., *Protein Sci* 15: 2558-67 (2006); Ponomarenko J, Bourne P, *BMC Struct Biol* 7: 64 (2007)). The various computational methods revealed similar predictions for B-cell epitope regions in three, prototypical, Shiga toxin A Subunits (Tables 1-3).

TABLE 1

B-Cell Epitope Predictions for the Mature, Native A Subunit of Shiga-like Toxin 1 (SEQ ID NO: 1)
natively positioned amino acid positions

| REVEAL | BcePred | Bepipred | ElliPro |
|---|---|---|---|
| | 29-35 | 28-34 | 27-37 |
| 42-48 | 39-46 | 43-47 | |
| 58-66 | 55-61 | 56-64 | 57-66 |
| 96-103 | 105-111 | 100-115 | 96-110 |
| 144-151 | 141-147 | 147-151 | 144-153 |
| 183-189 | 181-187 | 183-185 | 180-190 |
| | | 211-219 | |
| 243-251 | | | 243-257 |
| 257-268 | 261-267 | 254-268 | |
| 289-293 | 285-291 | | 262-293 |

TABLE 2

B-Cell Epitope Predictions for the Mature, Native A Subunit of Shiga Toxin (SEQ ID NO: 2)
natively positioned amino acid positions

| REVEAL | BcePred | Bepipred | ElliPro |
|---|---|---|---|
| | 29-35 | 28-34 | 27-37 |
| 42-48 | 39-46 | 44-47 | |
| 58-66 | 55-61 | 56-64 | 57-66 |
| 96-103 | 105-111 | 100-115 | 96-110 |
| 144-151 | 141-147 | 147-151 | 144-153 |
| 183-189 | 181-187 | 183-185 | 180-190 |
| | | 211-219 | |
| 243-251 | | | 243-257 |
| 257-268 | 261-267 | 254-268 | |
| 289-293 | 285-291 | | 262-293 |

TABLE 3

B-Cell Epitope Predictions for the Mature, Native A Subunit of Shiga-like Toxin 2 (SEQ ID NO: 3)
natively positioned amino acid positions

| BcePred | Bepipred | ElliPro |
|---|---|---|
| 3-11 | 8-14 | |
| 29-35 | 28-36 | 26-37 |
| | | 42-48 |
| | 57-62 | 56-66 |
| 108-115 | 109-115 | 96-110 |
| 141-156 | | 140-153 |
| | 179-188 | 180-191 |
| | 210-218 | 210-217 |
| 240-257 | 244-258 | 241-255 |
| | | 262-278 |
| | | 281-297 |

There were nine, predicted, B-cell epitope regions in SLT-1A which were identified by more than one method as overlapping regions (Table 4).

TABLE 4

Putative, B-Cell Epitope Regions in Prototypical, Shiga Toxin A Subunits
natively positioned amino acid positions

| SLT-1A | StxA | SLT-2A |
|---|---|---|
| | | 3-14 |
| 27-37 | 27-37 | 26-37 |
| 39-48 | 39-48 | 42-49 |
| 55-66 | 55-66 | 56-66 |
| 96-115 | 96-115 | 96-115 |
| 141-153 | 141-153 | 140-156 |
| 180-190 | 180-190 | 179-191 |
| | | 210-218 |
| 243-257 | 243-257 | 240-260 |
| 254-268 | 254-268 | 262-278 |
| 285-293 | 285-293 | 281-297 |

In addition, Shiga toxin A Subunits were analyzed using the Epitopia webserver for predicting B-cell epitopes and immunogenic residues (Rubinstein N et al., *BMC Bioinformatics* 10: 287 (2009)). Epitopia was used to identify linear, amino acid residue regions predicted to be immunogenic in SLT-1A based on an Epitopia score of 4 or 5 ("high") for the majority of amino acid residues within a linear, amino acid residue region.

The Epitopia analysis predicted an immunogenic region occurs from amino acid residues 1 to 15 in SLT-1A (designated as "Epitope Region 1", see Table 5). Based on the Epitopia analysis, the immunogenic epitope region 39-48 in SLT-1A (see Table 4) might include position 49 (designated as "Epitope Region 3", see Table 5). Based on the Epitopia analysis, the immunogenic epitope region 55-66 in SLT-1A (see Table 4) might include position 53 and extend to around position 62-66 (designated as "Epitope Region 4", see Table 5), the epitope region 96-115 in SLT-1A (see Table 4) might include position 94 (designated as "Epitope Region 5", see Table 5), and the epitope region 180-190 in SLT-1A (see Table 4) might start at position 179 and extend to around position 188-190 (designated as "Epitope Region 7", see Table 5).

TABLE 5

Prototypical, Shiga Toxin A Subunits Share Ten, Putative, B-Cell Epitope Regions

| Epitope Region | natively positioned amino acid positions |
|---|---|
| 1 | 1-15 |
| 2 | 26-37 |
| 3 | 39-49 |
| 4 | 53-66 |
| 5 | 94-115 |
| 6 | 141-153 |
| 7 | 179-190 |
| 8 | 243-257 |
| 9 | 254-268 |
| 10 | 285-293 |

T-cell epitopes were predicted for the mature, A Subunit of Shiga-like toxin 1 (SEQ ID NO:1) by the REVEAL™ Immunogenicity System (IS) T-cell assay performed by ProImmune, Inc. (Sarasota, Fla., U.S.). This assay uses multiple, overlapping peptides from a protein of interest to test for the elicitation of any immune response by mammalian, CD4+ T-cells from healthy donor cell samples depleted of CD8+ T-cells. ProImmune's REVEAL™ assay predicted seven, T-cell epitopes in SLT-1A (Table 6).

TABLE 6

| Putative, CD4+ T-Cell Epitopes in a Prototypical, Shiga Toxin A Subunit | |
|---|---|
| natively positioned amino acid positions | T-cell epitope # |
| 4-33 | 1 |
| 34-78 | 2 |
| 77-103 | 3 |
| 128-168 | 4 |
| 160-183 | 5 |
| 236-258 | 6 |
| 274-293 | 7 |

All of the ten, predicted, B-cell epitope regions (Table 5) overlapped with at least one, CD4+ T-cell epitope predicted by the REVEAL™ assay (Table 7).

TABLE 7

B-Cell Epitope Regions in Prototypical, Shiga Toxin A Subunits Overlap with Predicted, CD4+ T-Cell Epitopes

| | natively positioned amino acid positions | |
|---|---|---|
| Epitope Region | B-Cell Epitope Region | T-Cell Epitope(s) |
| 1 | 1-15 | 4-33 |
| 2 | 27-37 | 4-33; 34-78 |
| 3 | 39-48 | 34-78 |
| 4 | 53-66 | 34-78 |
| 5 | 94-115 | 77-103 |
| 6 | 141-153 | 128-168 |
| 7 | 179-190 | 160-183 |
| 8 | 243-257 | 236-258 |
| 9 | 254-268 | 236-258 |
| 10 | 285-293 | 274-293 |

In order to improve Shiga toxin-derived polypeptides for therapeutic and diagnostic applications in chordates, different Shiga toxin A Subunit effector polypeptides were constructed to be de-immunized and furin-cleavage resistant, as well as in some instances to comprise an embedded, heterologous, CD8+ T-cell epitope (referred to herein as "CD8+ T-cell hyper-immunized"). CD8+ T-cell epitopes were embedded or inserted into Shiga toxin effector polypeptides by engineering internal sub-regions of Shiga toxin effector polypeptides to comprise a heterologous, T-cell epitope (see e.g. WO 2015/113007). The embedding or inserting of heterologous, T-cell epitopes may be used to disrupt an endogenous, B-cell and/or CD4+ T-cell epitope region(s) in order to further de-immunize a Shiga toxin A Subunit derived scaffold (WO 2015/113007). All of the predicted, B-cell epitope regions and T-cell epitopes in Table 7 were disrupted and/or deleted individually or in combination in the following examples.

Example 2. Constructing and Testing Exemplary, Shiga Toxin Effector Polypeptides and Cell-Targeting Molecules of the Present Invention This example describes the creation and testing of various scaffolds comprising Shiga toxin effector polypeptides which are de-immunized, such as, e.g., as shown by reductions in antigenicity and/or immunogenicity relative to other Shiga toxin effector polypeptides. In addition, some of the Shiga toxin effector polypeptides of this Example are more protease-cleavage resistant than wild-type Shiga toxin effector polypeptides and/or comprise embedded or inserted, heterologous, CD8+ T-cell epitopes. The Shiga toxin effector polypeptides of this Example were tested as components of various, cell-targeting molecules of the present invention.

Construction of Exemplary, Shiga Toxin Effector Polypeptides (SLT-1A-combo(n)) and Cell-Targeting Molecules Comprising the Same (SLT-1A-combo(n):scFv-(n))

De-immunized, Shiga toxin A Subunit effector polypeptides were created and tested in the context of cell-targeting molecules, each comprising a cell-targeting, immunoglobulin-type binding region linked to a Shiga toxin effector polypeptide region.

To engineer protease-cleavage resistance into Shiga toxin A Subunit derived polypeptides, the amino acid residue substitutions, R248A and/or R251A, were introduced into Shiga toxin effector polypeptides (see e.g. WO 2015/191764). The R248A and R251A substitutions, either individually or in combination, disrupt the furin-cleavage motif at the carboxy-terminus of the Shiga toxin A1 fragment region and represent one or more mutations in the minimal, furin-cleavage motif relative to a wild-type Shiga toxin A Subunit (see WO 2015/191764).

For this Example, R248A and R251A were introduced into a Shiga toxin effector polypeptide derived from the A subunit of Shiga-like Toxin 1 (SLT-1A) comprising amino acids 1-251 of SLT-1A (SEQ ID NO:4). The SLT-1A 1-251 R248A/R251A double mutant (SEQ ID NO:5) is referred to herein as furin-cleavage resistant SLT-1A or more simply "SLT-1A-FR." The disruption of the minimal, furin-cleavage site R-x-x-R in the furin-cleavage motif at the carboxy-terminus of the Shiga toxin A1 fragment region with R248A and R251A results in decreased cleavage by furin (see Example 3, infra; WO 2015/191764). The disruption of the minimal furin-cleavage site R-x-x-R in the furin-cleavage motif natively positioned from amino acid residues 238 to 257 in StxA and SLT-1A was predicted to decrease the sensitivity of this region to proteolysis by other proteases such as, e.g., proprotein convertases and highly promiscuous proteases. In addition, the R248A and/or R251A mutations disrupt (1) B-cell epitope region #8, which is natively positioned at amino acid residues 243-259 in StxA and SLT-1A, and (2) a CD4+ T-cell epitope natively positioned at amino acid residues 236-258 in StxA and SLT-1A.

De-immunized, Shiga toxin effector polypeptides were created by adding multiple, amino acid residue substitutions to disrupt predicted B-cell and/or CD4+ T-cell epitope regions, including modifications resulting in embedded, heterologous, CD8+ T-cell epitopes (see Table 8; WO 2015/113005; WO 2015/113007). In order to create Shiga toxin effector polypeptides that were further de-immunized, SLT-1A-FR (SEQ ID NO:5) was modified to include multiple, amino acid residue substitutions to disrupt predicted B-cell and/or CD4+ T-cell epitope regions, including modifications resulting in embedded, heterologous, CD8+ T-cell epitopes (see Table 8; WO 2015/113005; WO 2015/113007). Table 8 shows twenty, different, de-immunized, protease-cleavage resistant, Shiga toxin A Subunit effector polypeptides named SLT-1A-combo(n), where n represents an integer such as 0, 1, 2, 3, etc. to denote different variations. The numbering of the endogenous epitope regions mentioned in Table 8 is in accord with the numbering scheme in Tables 6-7. The Shiga toxin effector polypeptides in Table 8 were tested as described in later sections.

TABLE 8

| Exemplary, De-Immunized, CD8+ T-Cell Hyper-Immunized, Shiga Toxin Effector Polypeptides of the Present Invention | | |
|---|---|---|
| SLT-1A-combo$_{(n)}$ name | Sequence | Summary Description |
| SLT-1A-combo0 | SEQ ID NO: 6 | epitope region 5 disrupted by amino acid substitutions<br>epitope region 5 disrupted by embedded, T-cell epitope<br>epitope region 8 disrupted by amino acid substitutions<br>epitope regions 8, 9, and 10 disrupted by truncation<br>furin-cleavage motif disrupted by R248A/R251A<br>T-cell epitope #6 disrupted by amino acid substitutions<br>T-cell epitopes #6 and #7 disrupted by truncation |
| SLT-1A-combo1 | SEQ ID NO: 7 | epitope region 4 disrupted by amino acid substitutions<br>epitope region 4 disrupted by embedded, T-cell epitope<br>epitope region 8 disrupted by amino acid substitutions<br>epitope regions 8, 9, and 10 disrupted by truncation<br>furin-cleavage motif disrupted by R248A/R251A<br>T-cell epitope #2 disrupted by amino acid substitutions<br>T-cell epitope #2 disrupted by embedded, T-cell epitope<br>T-cell epitope #6 disrupted by amino acid substitutions<br>T-cell epitopes #6 and #7 disrupted by truncation |
| SLT-1A-combo2 | SEQ ID NO: 8 | epitope region 3 disrupted by amino acid substitution<br>epitope region 4 disrupted by amino acid substitutions<br>epitope region 4 disrupted by embedded, T-cell epitope<br>epitope region 8 disrupted by amino acid substitutions<br>epitope regions 8, 9 and 10 disrupted by truncation<br>furin-cleavage site disrupted by R248A/R251A<br>T-cell epitope #2 disrupted by amino acid substitutions<br>T-cell epitope #2 disrupted by embedded, T-cell epitope<br>T-cell epitope #6 disrupted by amino acid substitutions<br>T-cell epitopes #6 and #7 disrupted by truncation |
| SLT-1A-combo3 | SEQ ID NO: 9 | epitope region 4 disrupted by amino acid substitutions<br>epitope region 4 disrupted by embedded, T-cell epitope<br>epitope region 8 disrupted by amino acid substitutions<br>epitope regions 8, 9 and 10 disrupted by truncation<br>furin-cleavage site disrupted by R248A/R251A<br>T-cell epitope #2 disrupted by amino acid substitutions<br>T-cell epitope #2 disrupted by embedded, T-cell epitope<br>T-cell epitope #6 disrupted by amino acid substitutions<br>T-cell epitopes #6 and #7 disrupted by truncation |

TABLE 8-continued

| Exemplary, De-Immunized, CD8+ T-Cell Hyper-Immunized, Shiga Toxin Effector Polypeptides of the Present Invention | | |
|---|---|---|
| SLT-1A-combo$_{(n)}$ name | Sequence | Summary Description |
| SLT-1A-combo4 | SEQ ID NO: 10 | epitope region 4 disrupted by amino acid substitutions<br>epitope region 4 disrupted by embedded, T-cell epitope<br>epitope region 8 disrupted by amino acid substitutions<br>epitope regions 8, 9 and 10 disrupted by truncation<br>furin-cleavage site disrupted by R248A/R251A<br>T-cell epitope #2 disrupted by amino acid substitutions<br>T-cell epitope #2 disrupted by embedded, T-cell epitope<br>T-cell epitope #6 disrupted by amino acid substitutions<br>T-cell epitopes #6 and #7 disrupted by truncation |
| SLT-1A-combo5 | SEQ ID NO: 11 | epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 7 disrupted by amino acid substitution<br>epitope regions 8, 9 and 10 disrupted by truncation<br>T-cell epitope #2 disrupted by amino acid substitutions<br>T-cell epitope #2 disrupted by embedded, T-cell epitope<br>T-cell epitopes #6 and #7 disrupted by truncation |
| SLT-1A-combo6 | SEQ ID NO: 12 | epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 7 disrupted by amino acid substitution<br>epitope region 8 disrupted by amino acid substitutions<br>epitope regions 8, 9 and 10 disrupted by truncation<br>T-cell epitope #2 disrupted by amino acid substitutions<br>T-cell epitope #2 disrupted by embedded, T-cell epitope<br>T-cell epitope #4 disrupted by amino acid substitution<br>T-cell epitopes #6 and #7 disrupted by truncation |
| SLT-1A-combo7 | SEQ ID NO: 13 | epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 7 disrupted by amino acid substitution<br>epitope region 8 disrupted by substitutions<br>furin-cleavage site disrupted by R248A/R251A<br>epitope regions 8, 9 and 10 disrupted by truncation<br>T-cell epitope #2 disrupted by amino acid substitutions |

TABLE 8-continued

Exemplary, De-Immunized, CD8+ T-Cell Hyper-Immunized, Shiga Toxin Effector Polypeptides of the Present Invention

| SLT-1A-combo$_{(n)}$ name | Sequence | Summary Description |
|---|---|---|
| | | T-cell epitope #2 disrupted by embedded, T-cell epitope<br>T-cell epitope #6 disrupted by amino acid substitutions<br>T-cell epitopes #6 and #7 disrupted by truncation |
| SLT-1A-combo21 | SEQ ID NO: 27 | epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 7 disrupted by amino acid substitution<br>epitope region 8 disrupted by substitutions<br>furin-cleavage site disrupted by R248A/R251A<br>epitope regions 8, 9 and 10 disrupted by truncation<br>T-cell epitope #2 disrupted by amino acid substitutions<br>T-cell epitope #2 disrupted by embedded, T-cell epitope<br>T-cell epitope #3 disrupted by amino acid substitution<br>T-cell epitope #6 disrupted by amino acid substitutions<br>T-cell epitopes #6 and #7 disrupted by truncation |
| SLT-1A-combo23 | SEQ ID NO: 29 | epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 7 disrupted by amino acid substitution<br>epitope region 8 disrupted by substitutions<br>furin-cleavage site disrupted by R248A/R251A<br>epitope regions 8, 9 and 10 disrupted by truncation<br>T-cell epitope #2 disrupted by amino acid substitutions<br>T-cell epitope #2 disrupted by embedded, T-cell epitope<br>T-cell epitope #3 disrupted by amino acid substitution<br>T-cell epitope #6 disrupted by amino acid substitutions<br>T-cell epitopes #6 and #7 disrupted by truncation |
| SLT-1A-combo24 | SEQ ID NO: 30 | epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 7 disrupted by amino acid substitution<br>epitope region 8 disrupted by substitutions<br>furin-cleavage site disrupted by R248A/R251A<br>epitope regions 8, 9 and 10 disrupted by truncation<br>T-cell epitope #2 disrupted by amino acid substitutions<br>T-cell epitope #2 disrupted by embedded, T-cell epitope<br>T-cell epitope #4 disrupted by amino acid substitution<br>T-cell epitope #6 disrupted by amino acid substitutions<br>T-cell epitopes #6 and #7 disrupted by truncation |
| SLT-1A-combo25 | SEQ ID NO: 31 | epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 7 disrupted by amino acid substitution<br>epitope region 8 disrupted by substitutions<br>furin-cleavage site disrupted by R248A/R251A<br>epitope regions 8, 9 and 10 disrupted by truncation<br>T-cell epitope #2 disrupted by amino acid substitutions<br>T-cell epitope #2 disrupted by embedded, T-cell epitope<br>T-cell epitope #4 disrupted by amino acid substitution<br>T-cell epitope #6 disrupted by amino acid substitutions<br>T-cell epitopes #6 and #7 disrupted by truncation |
| SLT-1A-combo26 | SEQ ID NO: 32 | epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 7 disrupted by amino acid substitution<br>epitope region 8 disrupted by substitutions<br>furin-cleavage site disrupted by R248A/R251A<br>epitope regions 8, 9 and 10 disrupted by truncation<br>T-cell epitope #2 disrupted by amino acid substitutions<br>T-cell epitope #2 disrupted by embedded, T-cell epitope<br>T-cell epitope #6 disrupted by amino acid substitutions<br>T-cell epitopes #6 and #7 disrupted by truncation |
| SLT-1A-combo8 | SEQ ID NO: 14 | epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 7 disrupted by amino acid substitution<br>epitope region 8 disrupted by substitutions<br>furin-cleavage site disrupted by R248A/R251A<br>epitope regions 8, 9 and 10 disrupted by truncation<br>T-cell epitope #2 disrupted by amino acid substitutions<br>T-cell epitope #2 disrupted by embedded, T-cell epitope<br>T-cell epitope #6 disrupted by amino acid substitutions |

TABLE 8-continued

Exemplary, De-Immunized, CD8+ T-Cell Hyper-Immunized, Shiga Toxin Effector Polypeptides of the Present Invention

| SLT-1A-combo$_{(n)}$ name | Sequence | Summary Description |
|---|---|---|
| | | T-cell epitopes #6 and #7 disrupted by truncation |
| SLT-1A-combo9 | SEQ ID NO: 15 | epitope region 3 disrupted by amino acid substitution |
| | | epitope region 4 disrupted by amino acid substitutions |
| | | epitope region 4 disrupted by embedded, T-cell epitope |
| | | epitope region 5 disrupted by amino acid substitution |
| | | epitope region 7 disrupted by amino acid substitution |
| | | epitope region 8 disrupted by substitutions |
| | | furin-cleavage site disrupted by R248A/R251A |
| | | epitope regions 8, 9 and 10 disrupted by truncation |
| | | T-cell epitope #2 disrupted by amino acid substitutions |
| | | T-cell epitope #2 disrupted by embedded, T-cell epitope |
| | | T-cell epitope #6 disrupted by amino acid substitutions |
| | | T-cell epitopes #6 and #7 disrupted by truncation |
| SLT-1A-combo10 | SEQ ID NO: 16 | epitope region 3 disrupted by amino acid substitution |
| | | epitope region 4 disrupted by amino acid substitutions |
| | | epitope region 4 disrupted by embedded, T-cell epitope |
| | | epitope region 5 disrupted by amino acid substitution |
| | | epitope region 6 disrupted by amino acid substitution |
| | | epitope region 8 disrupted by substitutions |
| | | furin-cleavage site disrupted by R248A/R251A |
| | | epitope regions 8, 9 and 10 disrupted by truncation |
| | | T-cell epitope #2 disrupted by amino acid substitutions |
| | | T-cell epitope #2 disrupted by embedded, T-cell epitope |
| | | T-cell epitope #4 disrupted by amino acid substitution |
| | | T-cell epitope #6 disrupted by amino acid substitutions |
| | | T-cell epitopes #6 and #7 disrupted by truncation |
| SLT-1A-combo11 | SEQ ID NO: 17 | epitope region 3 disrupted by amino acid substitution |
| | | epitope region 4 disrupted by amino acid substitutions |
| | | epitope region 4 disrupted by embedded, T-cell epitope |
| | | epitope region 5 disrupted by amino acid substitution |
| | | epitope region 7 disrupted by amino acid substitution |
| | | epitope region 8 disrupted by substitutions |
| | | furin-cleavage site disrupted by R248A/R251A |
| | | epitope regions 8, 9 and 10 disrupted by truncation |
| | | T-cell epitope #2 disrupted by amino acid substitutions |
| | | T-cell epitope #2 disrupted by embedded, T-cell epitope |
| | | T-cell epitope #6 disrupted by amino acid substitutions |
| | | T-cell epitopes #6 and #7 disrupted by truncation |

TABLE 8-continued

Exemplary, De-Immunized, CD8+ T-Cell Hyper-Immunized, Shiga Toxin Effector Polypeptides of the Present Invention

| SLT-1A-combo$_{(n)}$ name | Sequence | Summary Description |
|---|---|---|
| SLT-1A-combo12 | SEQ ID NO: 18 | epitope region 1 disrupted by amino acid substitution |
| | | epitope region 3 disrupted by amino acid substitution |
| | | epitope region 4 disrupted by amino acid substitutions |
| | | epitope region 4 disrupted by embedded, T-cell epitope |
| | | epitope region 5 disrupted by amino acid substitution |
| | | epitope region 6 disrupted by amino acid substitution |
| | | epitope region 8 disrupted by substitutions |
| | | furin-cleavage site disrupted by R248A/R251A |
| | | epitope regions 8, 9 and 10 disrupted by truncation |
| | | T-cell epitope #2 disrupted by amino acid substitutions |
| | | T-cell epitope #2 disrupted by embedded, T-cell epitope |
| | | T-cell epitope #4 disrupted by amino acid substitution |
| | | T-cell epitope #6 disrupted by amino acid substitutions |
| | | T-cell epitopes #6 and #7 disrupted by truncation |
| SLT-1A-combo13 | SEQ ID NO: 19 | epitope region 3 disrupted by amino acid substitution |
| | | epitope region 4 disrupted by amino acid substitutions |
| | | epitope region 4 disrupted by embedded, T-cell epitope |
| | | epitope region 7 disrupted by amino acid substitutions |
| | | epitope region 7 disrupted by embedded T-cell epitope |
| | | epitope region 8 disrupted by substitutions |
| | | furin-cleavage site disrupted by R248A/R251A |
| | | epitope regions 8, 9 and 10 disrupted by truncation |
| | | T-cell epitope #2 disrupted by amino acid substitutions |
| | | T-cell epitope #2 disrupted by embedded, T-cell epitope |
| | | T-cell epitope #4 disrupted by amino acid substitutions |
| | | T-cell epitope #6 disrupted by amino acid substitutions |
| | | T-cell epitopes #6 and #7 disrupted by truncation |
| SLT-1A-combo14 | SEQ ID NO: 20 | epitope region 3 disrupted by amino acid substitution |
| | | epitope region 4 disrupted by amino acid substitutions |
| | | epitope region 4 disrupted by embedded, T-cell epitope |
| | | epitope region 5 disrupted by amino acid substitution |
| | | epitope region 6 disrupted by amino acid substitution |
| | | epitope region 7 disrupted by amino acid substitution |
| | | epitope region 8 disrupted by substitutions |
| | | furin-cleavage site disrupted by R248A/R251A |
| | | epitope regions 8, 9 and 10 disrupted by truncation |
| | | T-cell epitope #2 disrupted by amino acid substitutions |
| | | T-cell epitope #2 disrupted by embedded, T-cell epitope |
| | | T-cell epitope #4 disrupted by amino acid substitution |

TABLE 8-continued

Exemplary, De-Immunized, CD8+ T-Cell Hyper-Immunized, Shiga Toxin Effector Polypeptides of the Present Invention

| SLT-1A-combo$_{(n)}$ name | Sequence | Summary Description |
|---|---|---|
| | | T-cell epitope #6 disrupted by amino acid substitutions<br>T-cell epitopes #6 and #7 disrupted by truncation |
| SLT-1A-combo15 | SEQ ID NO: 21 | epitope region 1 disrupted by amino acid substitution<br>epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 6 disrupted by amino acid substitution<br>epitope region 8 disrupted by substitutions<br>furin-cleavage site disrupted by R248A/R251A<br>epitope regions 8, 9 and 10 disrupted by truncation<br>T-cell epitope #2 disrupted by amino acid substitutions<br>T-cell epitope #2 disrupted by embedded, T-cell epitope<br>T-cell epitope #4 disrupted by amino acid substitution<br>T-cell epitope #6 disrupted by amino acid substitutions<br>T-cell epitopes #6 and #7 disrupted by truncation |
| SLT-1A-combo16 | SEQ ID NO: 22 | epitope region 1 disrupted by amino acid substitution<br>epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 6 disrupted by amino acid substitution<br>epitope region 7 disrupted by amino acid substitution<br>epitope region 8 disrupted by substitutions<br>furin-cleavage site disrupted by R248A/R251A<br>epitope regions 8, 9 and 10 disrupted by truncation<br>T-cell epitope #2 disrupted by amino acid substitutions<br>T-cell epitope #2 disrupted by embedded, T-cell epitope<br>T-cell epitope #4 disrupted by amino acid substitution<br>T-cell epitope #6 disrupted by amino acid substitutions<br>T-cell epitopes #6 and #7 disrupted by truncation |
| SLT-1A-combo17 | SEQ ID NO: 23 | epitope region 1 disrupted by amino acid substitutions<br>epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 6 disrupted by amino acid substitution<br>epitope region 7 disrupted by amino acid substitution<br>epitope region 8 disrupted by substitutions<br>furin-cleavage site disrupted by R248A/R251A<br>epitope regions 8, 9 and 10 disrupted by truncation<br>T-cell epitope #1 disrupted by amino acid substitution<br>T-cell epitope #2 disrupted by amino acid substitutions<br>T-cell epitope #2 disrupted by embedded, T-cell epitope<br>T-cell epitope #4 disrupted by amino acid substitution<br>T-cell epitope #6 disrupted by amino acid substitutions<br>T-cell epitopes #6 and #7 disrupted by truncation |
| SLT-1A-combo18 | SEQ ID NO: 24 | epitope region 1 disrupted by amino acid substitutions<br>epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 6 disrupted by amino acid substitution<br>epitope region 7 disrupted by amino acid substitution<br>epitope region 8 disrupted by substitutions<br>furin-cleavage site disrupted by R248A/R251A<br>epitope regions 8, 9 and 10 disrupted by truncation<br>T-cell epitope #1 disrupted by amino acid substitution<br>T-cell epitope #2 disrupted by amino acid substitutions<br>T-cell epitope #2 disrupted by embedded, T-cell epitope<br>T-cell epitope #4 disrupted by amino acid substitution<br>T-cell epitope #6 disrupted by amino acid substitutions<br>T-cell epitopes #6 and #7 disrupted by truncation |
| SLT-1A-combo19 | SEQ ID NO: 25 | epitope region 1 disrupted by amino acid substitution<br>epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 6 disrupted by amino acid substitution<br>epitope region 7 disrupted by substitutions<br>epitope region 8 disrupted by substitutions<br>furin-cleavage site disrupted by R248A/R251A<br>epitope regions 8, 9 and 10 disrupted by truncation<br>T-cell epitope #1 disrupted by amino acid substitution<br>T-cell epitope #2 disrupted by amino acid substitutions<br>T-cell epitope #2 disrupted by embedded, T-cell epitope<br>T-cell epitope #4 disrupted by amino acid substitution<br>T-cell epitope #5 disrupted by amino acid substitution |

TABLE 8-continued

Exemplary, De-Immunized, CD8+ T-Cell Hyper-Immunized, Shiga Toxin Effector Polypeptides of the Present Invention

| SLT-1A-combo$_{(n)}$ name | Sequence | Summary Description |
|---|---|---|
| | | T-cell epitope #6 disrupted by amino acid substitutions<br>T-cell epitopes #6 and #7 disrupted by truncation |
| SLT-1A-combo20 | SEQ ID NO: 26 | epitope region 3 disrupted by amino acid substitution<br>epitope region 4 disrupted by amino acid substitutions<br>epitope region 4 disrupted by embedded, T-cell epitope<br>epitope region 5 disrupted by amino acid substitution<br>epitope region 6 disrupted by amino acid substitution<br>epitope region 8 disrupted by substitutions<br>epitope region 8 disrupted by inserted, T-cell epitope<br>furin-cleavage site disrupted by R248A/R251A<br>epitope regions 8, 9 and 10 disrupted by truncation<br>T-cell epitope #2 disrupted by amino acid substitutions<br>T-cell epitope #2 disrupted by embedded, T-cell epitope<br>T-cell epitope #4 disrupted by amino acid substitution<br>T-cell epitope #6 disrupted by amino acid substitutions<br>T-cell epitope #6 disrupted by inserted, T-cell epitope<br>T-cell epitopes #6 and #7 disrupted by truncation |

Each of the de-immunized, Shiga toxin effector polypeptides SLT-1A-combo(n) (SEQ ID NOs: 6-21, 23-27, and 29-32) comprise a combination of one or more de-immunized sub-regions with one or more sub-regions that comprises an embedded, heterologous, CD8+ T-cell epitope. Most of these polypeptides also have a disrupted, minimal, furin-cleavage motif at the carboxy-terminal of their Shiga toxin A1 fragment sub-regions (SEQ ID NOs: 6-10, 13-21, 23-27, and 29-32). Computational analysis in silico predicted (1) that at least two, B-cell epitopes present in the wild-type Shiga toxin StxA or SLT-1A were eliminated for all of the Shiga toxin effector polypeptides combo(n) referred to in Table 8, and (2) that no new, B-cell epitopes were created in any of the Shiga toxin effector polypeptides combo(n) listed in Table 8. The properties and functional consequences of many of the modifications to individual sub-regions in Shiga toxin effector polypeptides combo(n) are described in Example 3, WO 2015/113005, WO 2015/113007, and WO 2015/191764.

Polynucleotides encoding Shiga toxin A Subunit effector polypeptide combination constructs were created and fused to a cell-targeting, immunoglobulin-type binding region encoding constructs using techniques known to the skilled worker. The resulting polynucleotides encoded cell-targeting molecules, each a polypeptide comprising (1) a combination, Shiga toxin effector polypeptide region SLT-1A-combo(n), (2) a cell-targeting binding region "scFv-(n)," where n represents an integer such as 1, 2, 3, etc. to denote different scFvs, and (3) a linker known in the art positioned between the Shiga toxin effector polypeptide region and the binding region.

Using a bacterial expression system known in the art, these polynucleotides were used to produce at least twenty-seven, combination, de-immunized, Shiga toxin effector polypeptides (Table 8; SEQ ID NOs: 6-21, 23-27, and 29-32), in the context of one or more cell-targeting molecules. After being linked to a cell-targeting binding region, twenty-six of the twenty-seven scaffolds SLT-1A-combo(n) produced a stable, full-length, catalytically active, cell-targeting molecule. However, the cell-targeting molecule SLT-1A-combo18::scFv-1 (SEQ ID NO:54) showed evidence of instability because SLT-1A-combo18::scFv-1 degradation was observed by sodium dodecyl sulfate (SDS), polyacrylamide gel electrophoretic (SDS-PAGE) analysis of gels loaded and ran with preparations of SLT-1A-combo18::scFv-1 and a molecular weight ladder as a reference.

A. Testing the Ribosome Inhibition Activities of Exemplary, Cell-Targeting Molecules Comprising Shiga Toxin Effector Polypeptides SLT-1A-Combo(n)

The enzymatic activities of various, combination, de-immunized, protease-cleavage resistant, Shiga toxin effector polypeptides were tested in the context of a cell-targeting molecule using an in vitro, ribosome inhibition assay known to the skilled worker (TNT® Quick Coupled Transcription/Translation Kit, Promega Corp., Madison, Wis., U.S.). This cell-free, in vitro, protein translation assay was used to determine the ribosome inactivation capabilities of SLT-1A-combo10:scFv-1 (SEQ ID NO:47), SLT-1A-combo16::scFv-1 (SEQ ID NO:52), SLT-1A-combo19::scFv-1 (SEQ ID NO:55), SLT-1A-combo0::scFv-2 (SEQ ID NO:57), SLT-1A-combo2::scFv-2 (SEQ ID NO:58), SLT-1A-combo3::scFv-2 (SEQ ID NO:59), SLT-1A-combo4::scFv-2 (SEQ ID NO:60), and SLT-1A-combo13::scFv-2 (SEQ ID NO:62).

The ribosome activity reaction was prepared according to manufacturer's instructions. A series of 10-fold dilutions of the cell-targeting molecule to be tested was prepared in an appropriate buffer and a series of identical TNT® reaction mixture components were created for each dilution. Each sample in the dilution series was combined with each of the TNT® reaction mixtures along with Luciferase T7 Control DNA (Promega Corp., Madison, Wis., U.S.). The test samples were incubated for 1.5 hours at 30 degrees Celsius (° C.). After the incubation, Luciferase Assay Reagent (Promega Corp., Madison, Wis., U.S.) was added to all test samples and the amount of luciferase protein translation was measured by luminescence according to manufacturer's instructions. Three positive controls were used: the wild-type, SLT-1A1 fragment (SLT-1A1-WT) (SEQ ID NO:4) and two cell-targeting molecules SLT-1A-FR::scFv-1 (SEQ ID NO:34) and SLT-1A-FR::scFv-2 (SEQ ID NO:35) comprising the protease-cleavage resistant, Shiga toxin effector polypeptide SLT-1A-FR (SEQ ID NO:5) (see WO 2015/191764).

The level of protein synthesis inhibition was determined by non-linear regression analysis of log-transformed concentrations of total cell-targeting molecule versus relative luminescence units. Using statistical software (GraphPad Prism, San Diego, Calif., U.S.), the half maximal inhibitory concentration ($IC_{50}$) value was calculated for each sample using the Prism software function of log(inhibitor) vs. response (three parameters) [$Y=Bottom+((Top-Bottom)/(1+10^{(X-Log\ IC_{50})}))$] under the heading dose-response-inhibition. The $IC_{50}$ for each sample was calculated and is shown in Table 9. In this assay, measurements of the inhibition of protein synthesis represent the ribosome inactivation activity of the sample molecule, which is one metric of the catalytic activity of a Shiga toxin effector polypeptide or a Shiga toxin A Subunit. As reported in the Examples, a molecule exhibiting an $IC_{50}$ within 10-fold of an $IC_{50}$ exhibited by a reference molecule is considered to exhibit ribosome inhibition activity comparable to that reference molecule. As reported in the Examples, a molecule exhibiting an $IC_{50}$ less than or within 10 percent of an $IC_{50}$ exhibited by a reference molecule is considered to exhibit ribosome inhibition activity equivalent to that reference molecule.

TABLE 9

Combination, De-Immunized, Protease-Cleavage Resistant, Shiga Toxin Effector Polypeptides Exhibited Ribosome Inhibition Activity Comparable to a Wild-Type Shiga toxin A1 Fragment

| Protein Sample | Ribosome Inhibition $IC_{50}$ (pM) |
|---|---|
| SLT-1A-combo10::scFv-1 | 2.8 |
| SLT-1A-combo16::scFv-1 | 3.3 |
| SLT-1A-combo19::scFv-1 | 2.2 |
| SLT-1A-FR::scFv-1 | 4.0 |
| SLT-1A-combo0::scFv-2 | 4.8 |
| SLT-1A-combo2::scFv-2 | 3.1 |
| SLT-1A-combo3::scFv-2 | 7.6 |
| SLT-1A-combo4::scFv-2 | 6.5 |
| SLT-1A-combo13::scFv-2 | 3.2 |
| SLT-1A-FR::scFv-2 | 5.9 |
| SLT-1A1-WT | 4.8 |

The ribosome inactivation activities of all the Shiga toxin effector polypeptides combo(n) tested were comparable to the catalytic activity of a wild-type Shiga toxin A1 fragment (SEQ ID NO:4) and/or a SLT-1A-FR polypeptide (SEQ ID NO:5) as a component of a cell-targeting molecule (Table 9; FIG. 2). The ribosome inactivation activities of SLT-1A-combo10::scFv-1, SLT-1A-combo16::scFv-1, SLT-1A-combo19::scFv-1, SLT-1A-combo0::scFv-2, SLT-1A-combo2::scFv-2, SLT-1A-combo4::scFv-1, and SLT-1A-combo13::scFv2 were equivalent to the catalytic activity of a wild-type Shiga toxin A1 fragment (SEQ ID NO:4) and/or a SLT-1A-FR polypeptide (SEQ ID NO:5) as a component of a cell-targeting molecule (Table 9; FIG. 2).

These results demonstrate that the ribosome inhibition activities of certain, exemplary, combination, de-immunized, protease-cleavage resistant, Shiga toxin effector polypeptides in the context of a cell-targeting molecule were comparable to the catalytic activity of a wild-type Shiga toxin A1 fragment (SEQ ID NO:4) alone or the Shiga toxin effector polypeptide SLT-1A-FR (SEQ ID NO:5) in the context of a cell-targeting molecule (Table 9; FIG. 2). Thus, the catalytic activities of certain, exemplary, combination, de-immunized, protease-cleavage resistant, Shiga toxin effector polypeptides in the context of a cell-targeting molecule appeared comparable in this assay to the catalytic activity of a wild-type Shiga toxin A Subunit (Table 9; FIG. 2).

B. Testing the Targeted Cytotoxicity of Exemplary, Cell-Targeting Molecules Comprising Shiga Toxin Effector Polypeptides SLT-1A-Combo(n)

The potency and specificity of cytotoxicity were tested for combination, de-immunized, Shiga toxin effector polypeptides SLT-1A-combo(n) of the present invention as scaffolds for building various cell-targeting molecules. The cytotoxic activities of exemplary, cell-targeting molecules comprising a combination, de-immunized, protease-cleavage resistant, Shiga toxin effector polypeptide SLT-1A-combo(n) were determined using a target biomolecule positive cell-kill assay known to the skilled worker. This target positive cell-kill assay was used to determine the cytotoxic activities of various cell-targeting molecules, each comprising a cell-targeting binding region scFv-(n) genetically fused to one of the combination, Shiga toxin effector polypeptides SLTA-1A-combo(n) (SEQ ID NOs: 6-32) (see Table 8 for a representative subset of such molecules) to form the cell-targeting molecules SEQ ID NOs: 43-81.

The cytotoxicities of cell-targeting molecules comprising de-immunized, protease-cleavage resistant, Shiga toxin effector polypeptides were determined using cells expressing, at a cellular surface, significant amounts of the appropriate, extracellular target biomolecule, such as, a target of the binding region scFv-1-8. The immunoglobulin-derived binding regions scFv-1, scFv-2, scFv-3, scFv-4, scFv-5, scFv-6, scFv-7, scFv-8, and scFv-9 each binds with high affinity to a human target biomolecule physically coupled to the cellular surfaces of certain human cells. The cells used in this Example were immortalized, human tumor cells available from the ATCC (Manassas Va., U.S.), National Cancer Institute of the U.S. (Frederick, Md., U.S.), and/or DSZM (Braunschweig, Del.). The cells referred to below were H929, Daudi, NCI-ADR/RES(expressing HER-2 from a transfected vector), HCC1419, MDA-MB-231, MOLP-8, ST486, HDLM-2, and L1236 or more simply cell-lines A, B, C, D, E, F, G, H, and I, respectively. Using a method known to the skilled worker, cells from cell-line C used in this Example were transfected with an expression vector and made to express a significant amount of cell-surface HER-2.

The cell-kill assay was performed as follows. Certain, human tumor, cell-line cells were plated (at about 2 to $8\times10^3$ cells per well) in 20 microliter (L) cell culture medium in 384-well plates. A series of 10-fold dilutions of the cell-targeting molecules to be tested were prepared in an appropriate buffer, and 5 μL of the dilutions or buffer control were added to the plated cells. Control wells containing only cell culture medium were used for baseline correction. The cell samples were incubated with the cell-targeting molecules or just buffer for three or five days at 37° C. and in an atmosphere of five percent carbon dioxide ($CO_2$). The total cell survival or percent viability was determined using a luminescent readout using the CellTiter-Glo® Luminescent Cell Viability Assay (G7573, Promega Corp., Madison, Wis., U.S.) according to the manufacturer's instructions.

The Percent Viability of experimental wells was calculated using the following equation: (Test RLU−Average Media RLU)/(Average Cells only RLU−Average Media RLU)*100. The logarithm of the cell-targeting molecule concentration versus Percent Viability was plotted in Prism (GraphPad Prism, San Diego, Calif., U.S.), and log (inhibitor) versus response (3 parameter) analysis was used to determine the half-maximal cytotoxic concentration ($CD_{50}$) value for the tested cell-targeting molecule. The $CD_{50}$ for each sample was calculated and is shown in Table 10. When $CD_{50}$ values could not be calculated based on the shape of the curve over the concentrations tested, then a maximum $CD_{50}$ value was noted as being beyond the maximum tested value, e.g., greater than 100 nM (">100.000 nM") or 200 nM (">200.000 nM"), for samples which did not kill 50% of the cells at the highest, tested, sample concentration, e.g., 100.000 nM or 200.000 nM. If the cell viability in the assay was approximately 50% at the highest tested sample concentration, then the $CD_{50}$ value for that molecule was noted in Table 10 as being approximately the maximum concentration tested where the cell viability was approximately 50%, e.g., "~100.000 nM." As reported in the Examples, a molecule exhibiting a $CD_{50}$ within 10-fold of a $CD_{50}$ exhibited by a reference molecule is considered to exhibit cytotoxic activity comparable to that reference molecule.

TABLE 10

Exemplary, De-Immunized, Protease-Cleavage Resistant, Shiga Toxin Effector Polypeptides Exhibited Potent Cytotoxicity

| Cell-Targeting Molecule Set 1-scFv-1 | $CD_{50}$ (nM) scFv-1 target positive cell line A | $CD_{50}$ (nM) scFv-1 target positive cell line B | |
|---|---|---|---|
| Experiment 1 | | | |
| SLT-1A-combo10:: scFv-1 | 0.025 | 0.079 | |
| SLT-1A-combo16:: scFv-1 | 0.032 | 0.115 | |
| SLT-1A-combo19:: scFv-1 | 0.032 | 0.157 | |
| SLT-1A-FR::scFv-1 | 0.014 | 0.045 | |
| Experiment 2 | | | |
| SLT-1A-combo17::scFv-1 | 0.040 | ~100.000 | |
| SLT-1A-combo18::scFv-1 | >100.000 | >100.000 | |
| SLT-1A-FR::scFv-1 | 0.007 | 0.048 | |
| SLT-1A-WT | >100.000 | >100.000 | |
| Experiment 3 | | | |
| SLT-1A-combo7::scFv-1 | 0.026 | | |
| SLT-1A-FR::scFv-1 | 0.017 | | |
| Cell-Targeting Molecule Set 1, Experiment 3 (cont'd) | $CD_{50}$ (nM) scFv-1 target positive cell line F | $CD_{50}$ (nM) scFv-1 target positive cell line G | $CD_{50}$ (nM) scFv-1 target positive cell line H |
| SLT-1A-combo7::scFv-1 | 0.386 | 0.133 | >100.000 |
| SLT-1A-FR::scFv-1 | 0.283 | 0.099 | >100.000 |
| Experiment 4 | scFv-1 target positive cell line A | scFv-1 target positive cell line G | |
| SLT-1A-combo1::scFv-1 | 0.017 | 0.024 | |
| SLT-1A-combo10::scFv-1 | 0.027 | 0.068 | |
| SLT-1A-combo12::scFv-1 | 0.067 | 0.182 | |
| SLT-1A-combo15::scFv-1 | 0.054 | 0.094 | |
| SLT-1A-combo17::scFv-1 | 0.088 | 0.162 | |
| SLT-1A-FR::scFv-1 | 0.013 | 0.020 | |
| Experiment 5 | scFv-1 target positive cell line A | scFv-1 target positive cell line F | scFv-1 target positive cell line G |
| SLT-1A-combo7::scFv-1 | 0.01 | 0.12 | 0.02 |
| SLT-1A-combo8::scFv-1 | 0.01 | 0.14 | 0.04 |
| SLT-1A-combo9::scFv-1 | 0.01 | 0.33 | 0.13 |
| SLT-1A-combo11::scFv-1 | 0.02 | 0.67 | 0.55 |
| Experiment 6 | scFv-1 target positive cell line A | scFv-1 target positive cell line B | scFv-1 target positive cell line F |
| SLT-1A-combo10::scFv-1 | 0.03 | 0.25 | 0.84 |
| SLT-1A-combo20::scFv-1 | 0.17 | 0.79 | 3.21 |
| Set 2-scFv-2 | scFv-2 target positive cell line A | scFv-2 target positive cell line B | scFv-2 target positive cell line G |
| Experiment 7 | | | |
| SLT-1A-combo0::scFv-2 | 1.52 | 17.2 | |

TABLE 10-continued

| Exemplary, De-Immunized, Protease-Cleavage Resistant, Shiga Toxin Effector Polypeptides Exhibited Potent Cytotoxicity | | | |
|---|---|---|---|
| SLT-1A-combo3::scFv-2 | 0.68 | 3.18 | |
| SLT-1A-combo4::scFv-2 | 0.08 | 0.44 | |
| SLT-1A-FR::scFv-2 | 0.01 | 0.06 | |
| Experiment 8 | | | |
| SLT-1A-combo2::scFv-2 | 2.206 | 1.70 | 0.798 |
| SLT-1A-combo13::scFv-2 | >100.000 | >100.000 | >100.000 |
| SLT-1A-FR::scFv-2 | 0.119 | 0.171 | 0.112 |
| Experiment 9 | | | |
| SLT-1A-combo22::scFv-2 | 0.059 | 0.259 | 0.110 |
| SLT-1A-FR::scFv-2 | 0.041 | 0.172 | 0.070 |
| scFv-3 Experiment 10 | scFv-3 target positive cell line B | scFv-3 target positive cell line G | scFv-3 target negative cell line A |
| scFv-3::SLT-1A-combo5 | 73.80 | 5.48 | >200.00 |
| scFv-3::SLT-1A-combo6 | 54.70 | 1.01 | >200.00 |
| scFv-3::SLT-1A | 119.00 | 0.79 | >200.00 |
| scFv-4 Experiment 11 | scFv-4 target positive cell line C | scFv-4 target positive cell line D | scFv-4 target negative cell line E |
| SLT-1A-combo7::scFv-4 | 0.045 | 0.059 | >200.000 |
| SLT-1A-combo14::scFv-4 | 0.065 | 0.079 | >200.000 |
| SLT-1A-FR::scFv-4 | 0.012 | 0.018 | >200.000 |
| Set 3-scFv-5 | | | |
| Experiment 12 | scFv-5 target positive cell line I | scFv-5 target positive cell line H | |
| SLT-1A-combo7::scFv-5 | 0.037 | 0.029 | |
| SLT-1A-FR::scFv5 | 0.012 | 0.012 | |
| Experiment 13 | | | |
| SLT-1A-combo8::scFv-5 | 0.064 | | |
| SLT-1A-combo9::scFv-5 | 0.376 | | |
| SLT-1A-combo11::scFv-5 | ~100.000 | | |
| SLT-1A-FR::scFv-5 | 0.011 | | |
| Set 4-scFv-6 | scFv-6 target positive cell line I | scFv-6 target positive cell line H | |
| Experiment 14 | | | |
| SLT-1A-combo7::scFv-6 | 0.037 | 0.157 | |
| SLT-1A-FR::scFv-6 | 0.075 | 0.038 | |
| Experiment 15 | | | |
| SLT-1A-combo8::scFv-6 | 1.699 | | |
| SLT-1A-combo9::scFv-6 | ~100.000 | | |
| SLT-1A-FR::scFv-6 | 0.204 | | |
| Experiment 16 | | | |
| SLT-1A-combo7::scFv-6 | 0.240 | | |
| SLT-1A-combo21::scFv-6 | 1.900 | | |
| SLT-1A-combo23::scFv-6 | 0.260 | | |

TABLE 10-continued

| Exemplary, De-Immunized, Protease-Cleavage Resistant, Shiga Toxin Effector Polypeptides Exhibited Potent Cytotoxicity | | |
|---|---|---|
| SLT-1A-combo24::scFv-6 | 0.310 | |
| SLT-1A-FR::scFv-6 | 0.130 | |
| Experiment 17 | scFv-6 target positive cell line I | |
| SLT-1A-combo7::scFv-6 | 0.500 | |
| SLT-1A-combo25::scFv-6 | 0.100 | |
| SLT-1A-combo26::scFv-6 | 0.730 | |
| scFv-8 Experiment 18 | scFv-8 positive cell line B | scFv-8 negative cell line A |
| SLT-1A-combo0::scFv-8 | 0.077 | >100.000 |
| SLT-1A-FR::scFv-8 | 0.440 | >100.000 |

The $CD_{50}$ values for exemplary, SLT-1A-combo scaffold-based, cell-targeting molecules are shown in Table 10 and associated cell-kill assay data is shown in FIGS. 3-10. These results show the cell-kill assay results for at least thirty-four, unique, cell-targeting molecules each comprising a combination, de-immunized, Shiga toxin effector polypeptide SLT-1A-combo(n) selected from at least twenty-six Shiga toxin effector polypeptides (SEQ ID NOs: 6-27 and 29-32). Thirty-two of thirty-four combination, de-immunized, Shiga toxin effector polypeptides SLT-1A-combo(0-12, 14-17, 19-21, 23-27, and 29-32) effectuated cytotoxicities, in the context of a cell-targeting molecule, characterized by $CD_{50}$ values equal to or less than 100 nM, whereas two cell-targeting molecules, comprising either SLT-1A-combo13 (SEQ ID NO:19) and SLT-1A-combo18 (SEQ ID NO:24), exhibited cytotoxicities characterized by $CD_{50}$ values greater than 100 nM toward the two cell-lines tested (Table 10; FIGS. 6-7).

The results reported in Table 10 show that the cell-targeting molecules comprising SLT-1A-combo0, SLT-1A-combo1, SLT-1A-combo4, SLT-1A-combo7, SLT-1A-combo8, SLT-1A-combo9, SLT-1A-combo10, SLT-1A-combo11, SLT-1A-combo12, SLT-1A-combo14, SLT-1A-combo15, SLT-1A-combo16, SLT-1A-combo17, SLT-1A-combo19, or SLT-1A-combo25 displayed potent cytotoxicities characterized by $CD_{50}$ values of 0.2 nM or less depending on the cell-line tested (Table 10; FIGS. 3-10). The cytotoxicities of most of the Shiga toxin effector polypeptides combo(n) tested as a component of a cell-targeting molecule were comparable to the cytotoxicities of a SLT-1A-FR polypeptide (SEQ ID NO:5) as a component of a related, cell-targeting molecule (Table 10; FIGS. 3-7; 9-10). For example, the cytotoxicities to at least one cell-type tested for at least one cell-targeting molecule comprising one of the Shiga toxin effector polypeptides combo(0-2, 4, 7-8, 10, 12, 14-19, or 23-26) were comparable to the cytotoxicities of related, cell-targeting molecules comprising a SLT-1A-FR polypeptide (SEQ ID NO:5) (Table 10; FIGS. 3-7; 9-10).

The specificity of the cytotoxicities of exemplary, cell-targeting molecules comprising certain, combination, de-immunized, Shiga toxin effector polypeptides SLT-1A-combo(n) were determined using target-negative cell-kill assays known to the skilled worker. The target biomolecule negative cell-kill assay is identical to the target-positive cell-kill assay except for the cell type used. The target negative cell-kill assay was performed using cells which do not express significant amounts of the extracellular target biomolecule bound with high-affinity by the respective binding region scFv-(n) of the cell-targeting molecule being tested. The cytotoxic specificities of exemplary, cell-targeting molecules comprising certain, combination, de-immunized, Shiga toxin effector polypeptide scaffolds SLT-1A-combo(n) were determined by comparing the results from target positive cell-kill assays with results from target-negative cell-kill assays (see e.g. Table 10; FIGS. 8-9). Cytotoxic, cell-targeting molecules comprising de-immunized, Shiga toxin effector polypeptides SLT1-A-combo(5-7, 14, or 21) or SLT-1A-FR (SEQ ID NO:5) did not kill comparable percentages of target negative cells as compared to target positive cells at the same, cell-targeting molecule concentrations (Table 10; FIGS. 8-9).

C. Testing for Caspase Activation Induced by Exemplary, Cell-Targeting Molecules Comprising Shiga Toxin Effector Polypeptides SLT-1A-Combo(n)

Apoptosis is a programmed cell death involving the degradation of cellular components by caspases. Apoptosis can be detected by monitoring the activity of the effector caspases 3 and 7, such as, e.g., the activation state of either caspase 3 or caspase 7. The caspase activation of exemplary, cell-targeting molecules comprising combination, de-immunized, protease-cleavage resistant, Shiga toxin effector polypeptides SLT-1A-combo(n) of the present invention were determined using a target biomolecule positive cell, caspase activity assay known to the skilled worker. The method of the target positive cell, caspase activity assay is analogous to the target-positive cell-kill assay described above.

Shiga toxin catalytic activity can induce apoptosis of Shiga toxin-intoxicated, mammalian cells via an intrinsic pathway (see e.g., Inward C et al., *J Infect* 30: 213-8 (1995); Fujii J et al., *Infect Immun* 71: 2724-35 (2003); Jandhyala D et al., *Curr Top Microbiol Immunol* 357: 41-65 (2012); Tesh V, *Curr Top Microbiol Immunol* 357: 137-78 (2012)). Caspase activation can be used as a readout for the activation of apoptotic mechanisms leading to cell death (see Pop C, Salvesen G, *J Biol Chem* 284: 21777-81 (2009); Nicholls S, Hyman B, *Methods Enzymol* 544: 251-69 (2014)). The potency and specificity of caspase activation induced by the combination, de-immunized, protease-cleavage resistant, Shiga toxin effector polypeptides SLT-1A-combo7 and SLT-1A-combo14 in the context of a cell-targeting molecules were determined as follows.

The caspase activation of cell-targeting molecules comprising de-immunized, protease-cleavage resistant, Shiga toxin effector polypeptide scaffolds were determined using cells expressing, at a cellular surface, significant amounts of an extracellular target biomolecule of the binding region scFv-1 or scFv-6.

The caspase activation assay was performed as follows. Certain, human tumor, cell-line cells were plated (at about $2\text{-}8\times10^3$ cells per well) in 20 microliter (L) cell culture medium in 384-well plates. A series of 10-fold dilutions of the cell-targeting molecules to be tested were prepared in an appropriate buffer, and 5 L of the dilutions or buffer control were added to the plated cells. Control wells containing only cell culture medium were used for baseline correction. The cell samples were incubated with the cell-targeting molecules or just buffer for 18-20 hours at 37° C. and in an atmosphere of five percent $CO_2$. The caspase activation was determined using a luminescent readout using the Caspase-Glo 3/7@ Luminescent Cell Viability Assay (Promega Corp., Madison, Wis., U.S.) according to the manufacturer's instructions.

The amount of caspase activation in experimental wells was calculated using the following equation: ((Test RLU−Average Media RLU)/(Average Cells RLU−Average Media RLU))*100. The logarithm of the cell-targeting molecule concentration versus Caspase Activation was plotted in Prism (GraphPad Prism, San Diego, Calif., U.S.) and log (agonist) versus response (3 parameter) analysis was used for each, tested, cell-targeting molecule to calculate the half-maximal effective concentration ($EC_{50}$) value for caspase activation in the assay (FIGS. 11-12; Table 11). The maximum caspase activity percentage (the percent activation over the "cells only" control measurements) for each experiment (maximum activity) was calculated using caspase activation measurements from samples with "cells only" as the baseline (Table 11). The $EC_{50}$ and maximum activity for caspase activation for exemplary cell-targeting molecules are shown in Table 11.

TABLE 11

Exemplary, De-Immunized, Protease-Cleavage Resistant, Cell-Targeting Molecules Induced Caspase Activation

| Cell-Targeting Molecule | caspase activity $EC_{50}$ (nM) | maximum activity (%) | caspase activity $EC_{50}$ (nM) | maximum activity (%) |
|---|---|---|---|---|
| | scFv-1 target positive cell line A | | scFv-1 target positive cell line G | |
| SLT-1A-combo7::scFv-1 | 0.072 | 562 | 0.066 | 245 |
| SLT-1A-combo14::scFv-1 | 0.083 | 534 | 0.094 | 245 |
| SLT-1A-FR::scFv-1 | 0.054 | 561 | 0.045 | 250 |
| | scFv-7 target positive cell line H | | scFv-7 target positive cell line I | |
| SLT-1A-combo7::scFv-7 | 2.410 | 219 | 0.210 | 216 |
| SLT-1A-FR::scFv-7 | 0.860 | 335 | 0.050 | 234 |

The caspase activity in target cells induced by the Shiga toxin effector polypeptide combos 7 and 14, each tested as a component of a cell-targeting molecule, were comparable to the caspase activity induced by the SLT-1A-FR polypeptide (SEQ ID NO:5) as a component of a related, cell-targeting molecule (SEQ ID NO:34 and SEQ ID NO:39, respectively) for most of the cell-lines tested (Table 11; FIGS. 11-12).

D. Endogenous Epitope Disrupting Mutations in Shiga Toxin Effector Polypeptides

This Example shows that Shiga toxin A Subunit effector polypeptides can be de-immunized with certain truncations and combinations of amino acid residue substitutions. Deletions and/or amino acid substitutions were made in the putative, B-cell and/or T-cell epitopes of Shiga toxin effector polypeptides derived from the A Subunit of Shiga-like Toxin 1(SLT-1A) as listed in Table 12. In this Examples and in WO2015/113005, many mutations have been empirically tested for effect(s) on the Shiga toxin effector function of various Shiga toxin effector polypeptides and cell-targeting molecules. Table 12 summarizes the results described in the Examples and in WO 2015/113005 where an amino acid substitution or combination of amino acid substitutions did not prevent the exhibition of a potent level of Shiga toxin effector function. Table 12 uses the epitope region numbering scheme described in the Example 1 (see Table 7, supra), and lists any change in B-cell epitopes predicted by BcePred software.

TABLE 12

Substitutions and Combinations of Substitutions Empirically Verified Not to Prevent Exhibition of a Potent Shiga Toxin Effector Function(s)
natively positioned amino acid positions

| Epitope Region | Substitution(s) | Epitope Prediction | Ribosome Inhibition | Cytotoxicity |
|---|---|---|---|---|
| 1 | K1M/K11A | no change | YES | YES |
| 1 | S8I | no change | YES | YES |
| 1 | T9I | no change | YES | YES |
| 2 | S33I | eliminated | YES | YES |
| 3 | T45I | eliminated | YES | YES |
| 3 | S45I | eliminated | YES | YES |
| 4 | D53A | no change | YES | YES |
| 4 | R55A | no change | YES | YES |
| 4 | D58A | eliminated | YES | YES |
| 4 | D58F | eliminated | YES | YES |
| 4 | P59A | eliminated | YES | YES |
| 4 | E60I | eliminated | YES | YES |
| 4 | E60R | no change | YES | YES |
| 4 | E61A | eliminated | YES | YES |
| 4 | G62A | eliminated | YES | YES |

TABLE 12-continued

Substitutions and Combinations of Substitutions Empirically Verified Not to Prevent Exhibition of a Potent Shiga Toxin Effector Function(s) natively positioned amino acid positions

| Epitope Region | Substitution(s) | Epitope Prediction | Ribosome Inhibition | Cytotoxicity |
|---|---|---|---|---|
| 5 | D94A/S96I | no change | YES | YES |
| 7 | D183A | no change | YES | YES |
| 7 | D184A | eliminated | YES | YES |
| 7 | D184F | eliminated | YES | YES |
| 7 | R188A | eliminated | YES | YES |
| 7 | D183A/D184A/R188A | eliminated | YES | YES |
| immunogenic residue | R205A | eliminated | YES | YES |
| 4 and 5 | E60I/G110A | eliminated | YES | YES |
| 4 and 6 | E60I/G147A | eliminated | YES | YES |
| 3 and 7 | T45I/R188A | eliminated | YES | YES |
| 3 and 7 | S45I/R188A | eliminated | YES | YES |
| 2, 4, and 6 | S33I/G110A/G147A | eliminated | YES | YES |
| 3, 4, and 6 | T45I/G110A/G147A | eliminated | YES | YES |
| 3, 4, and 6 | S45I/G110A/G147A | eliminated | YES | YES |
| 4, 5, and 6 | D58A/G110A/G147A | eliminated | YES | YES |
| 4, 5, and 6 | E60I/G110A/G147A | eliminated | YES | YES |
| 3, 4, 5, and 6 | T45I/D58A/E60I/G110A/G147A | eliminated | YES | YES |
| 3, 4, 5, and 6 | S45I/D58A/E60I/G110A/G147A | eliminated | YES | YES |
| 3, 4, 5, and 6 | T45I/D58A/E60I/G62A/G110A/G147A | eliminated | YES | YES |
| 3, 4, 5, and 6 | S45I/D58A/E60I/G62A/G110A/G147A | eliminated | YES | YES |
| 3, 4, 5, 6, and 7 | T45I/G110A/G147A/D183A/D184A/R188A | eliminated | YES | YES |
| 3, 4, 5, 6, and 7 | S45I/G110A/G147A/D183A/D184A/R188A | eliminated | YES | YES |
| 4, 5, 6, and 7 | D58A/G110A/G147A/S186A | eliminated | YES | YES |
| 4, 5, 6, and 7 | D58A/G110A/G147A/G187A | eliminated | YES | YES |
| 4, 5, 6, and 7 | D58A/G110A/G147A/R188A | eliminated | YES | YES |
| 4, 5, 6, and 7 | D58A/G110A/G147A/S189A | eliminated | YES | YES |
| 4, 5, 6, and 7 | D58A/G110A/G147A/S186A/R188A | eliminated | YES | YES |
| 4, 5, 6, and 7 | D58A/G110A/G147A/G187A/R188A | eliminated | YES | YES |
| 2, 3, 4, 5, and 6 | S33I/S45I/D58A/G110A/G147A | eliminated | YES | YES |
| 3, 4, 5, 6, and 7 | T45I/D58A/E60I/G110A/G147A/D183A/D184A/R188A | eliminated | YES | YES |
| 3, 4, 5, 6, and 7 | S45I/D58A/E60I/G110A/G147A/D183A/D184A/R188A | eliminated | YES | YES |
| 3, 4, 5, 6, and 7 | T45I/D58A/E60I/G62A/G110A/G147A/D183A/D184A/R188A | eliminated | YES | YES |
| 3, 4, 5, 6, and 7 | S45I/D58A/E60I/G62A/G110A/G147A/D183A/D184A/R188A | eliminated | YES | YES |
| 4, 5, 6, 7, and 8 | D58A/G110A/G147A/R188A/C242S/R248A/R251A | eliminated | YES | YES |

TABLE 12-continued

| Substitutions and Combinations of Substitutions Empirically Verified Not to Prevent Exhibition of a Potent Shiga Toxin Effector Function(s) natively positioned amino acid positions | | | | |
|---|---|---|---|---|
| Epitope Region | Substitution(s) | Epitope Prediction | Ribosome Inhibition | Cytotoxicity |
| 5 and 8 | T104N/A105L/T107P/L108M/S109V/G110A/D111T/R248A/R251A | eliminated | YES | YES |
| 4 and 8 | V54I/R55L/I57F/P59F/E60T/E61L/R248A/R251A | eliminated | | YES |
| 3 and 8 | 543N/G44L/T45V/G46P/D47M/N48V/L49A/F50T/A51V/R248A/R251A | eliminated | YES | YES |
| 3 and 8 | S43N/G44L/S45V/G46P/D47M/N48V/L49A/F50T/A51V/R248A/R251A | eliminated | YES | YES |
| 3, 4, and 8 | T45I/V54I/R55L/I57F/P59F/E60T/E61L/C242S/R248A/R251A | eliminated | YES | YES |
| 3, 4, and 8 | S45I/V54I/R55L/I57F/P59F/E60T/E61L/C242S/R248A/R251A | eliminated | YES | YES |
| 4 and 8 | D53N/V54L/R55V/G56P/I57M/D58V/P59A/E60T/E61V/R248A/R251A | eliminated | YES | YES |
| 3, 4, 5, and 7 | T45I/V54I/R55L/I57F/P59F/E60T/E61L/G110A/R188A | eliminated | | YES |
| 3, 4, 5, and 7 | S45I/V54I/R55L/I57F/P59F/E60T/E61L/G110A/R188A | eliminated | | YES |
| 4, 5, 6, and 8 | D58A/G110A/G147A /R188A/C242S | eliminated | YES | YES |
| 3, 4, 5, 6, and 7 | T45I/V54I/R55L/I57F/P59F/E60T/E61L/G110A/G147A/R188A | eliminated | | YES |
| 3, 4, 5, 6, and 7 | S45I/V54I/R55L/I57F/P59F/E60T/E61L/G110A/G147A/R188A | eliminated | | YES |
| 3, 4, 5, 7, and 8 | T45I/V54I/R55L/I57F/P59F/E60T/E61L/G110A/R188A/C242S/R248A/R251A | eliminated | | YES |
| 3, 4, 5, 7, and 8 | S45I/V54I/R55L/I57F/P59F/E60T/E61L/G1 10A/R188A/C242S/R248A/R251A | eliminated | | YES |
| 3, 4, 5, 7, and 8 | T45I/V54I/R55L/I57F/P59F/E60T/E61L/R84A/G110A/R188A/C242S/R248A/R251A | eliminated | | YES |

TABLE 12-continued

Substitutions and Combinations of Substitutions Empirically Verified Not to Prevent Exhibition of a Potent Shiga Toxin Effector Function(s) natively positioned amino acid positions

| Epitope Region | Substitution(s) | Epitope Prediction | Ribosome Inhibition | Cytotoxicity |
|---|---|---|---|---|
| 3, 4, 5, 7, and 8 | S45I/V54I/R55L/I57F/P59F/E60T/E61L/R84A/G110A/R188A/C242S/R248A/R251A | eliminated | | YES |
| 3, 4, 5, 7, and 8 | T45I/V54I/R55L/I57F/P59F/E60T/E61L/V88A/G110A/R188A/C242S/R248A/R251A | eliminated | | YES |
| 3, 4, 5, 7, and 8 | S45I/V54I/R55L/I57F/P59F/E60T/E61L/V88A/G110A/R188A/C242S/R248A/R251A | eliminated | | YES |
| 3, 4, 5, 7, and 8 | T45I/V54I/R55L/I57F/P59F/E60T/E61L/G110A/D141A/R188A/C242S/R248A/R251A | eliminated | | YES |
| 3, 4, 5, 7, and 8 | S45I/V54I/R55L/I57F/P59F/E60T/E61L/G110A/D141A/R188A/C242S/R248A/R251A | eliminated | | YES |
| 3, 4, 5, 7, and 8 | T45I/V54I/R55L/I57F/P59F/E60T/E61L/G110A/V154A/R188A/C242S/R248A/R251A | eliminated | | YES |
| 3, 4, 5, 7, and 8 | S45I/V54I/R55L/I57F/P59F/E60T/E61L/G110A/V154A/R188A/C242S/R248A/R251A | eliminated | | YES |
| 3, 4, 5, 7, and 8 | T45I/V54I/R55L/I57F/P59F/E60T/E61L/G110A/R188A/D198A/C242S/R248A/R251A | eliminated | | YES |
| 3, 4, 5, 7, and 8 | S45I/V54I/R55L/I57F/P59F/E60T/E61L/G110A/R188A/D198A/C242S/R248A/R251A | eliminated | | YES |
| 3, 4, 5, 7, and 8 | T45I/V54I/R55L/I57F/D58V/P59F/E60T/E61L/G110A/R188A/C242S/R248A/R251A | eliminated | | YES |
| 3, 4, 5, 7, and 8 | S45I/V54I/R55L/I57F/D58V/P59F/E60T/E61L/G110A/R188A/C242S/R248A/R251A | eliminated | | YES |
| 3, 4, 5, 7, and 8 | T45I/D53G/V54I/R55L/I57F/P59F/E60T/E61L/G110A/R188A/C242S/R248A/R251A | eliminated | | YES |

TABLE 12-continued

Substitutions and Combinations of Substitutions Empirically Verified Not to Prevent Exhibition of a Potent Shiga Toxin Effector Function(s) natively positioned amino acid positions

| Epitope Region | Substitution(s) | Epitope Prediction | Ribosome Inhibition | Cytotoxicity |
|---|---|---|---|---|
| 3, 4, 5, 7, and 8 | S45I/D53G/V54I/R55L/I57F/P59F/E60T/E61L/G110A/R188A/C242S/R248A/R251A | eliminated | | YES |
| 3, 4, 5, 6, and 8 | T45I/V54I/R55L/I57F/P59F/E60T/E61L/G110A/G147A/C242S/R248A/R251A | eliminated | YES | YES |
| 3, 4, 5, 6, and 8 | S45I/V54I/R55L/I57F/P59F/E60T/E61L/G110A/G147A/C242S/R248A/R251A | eliminated | YES | YES |
| 3, 4, 5, 7, and 8 | T45I/D53G/V54I/R55L/I57F/D58V/P59F/E60T/E61L/G110A/R188A/C242S/R248A/R251A | eliminated | | YES |
| 3, 4, 5, 7, and 8 | S45I/D53G/V54I/R55L/I57F/D58V/P59F/E60T/E61L/G110A/R188A/C242S/R248A/R251A | eliminated | | YES |
| 3, 4, 7, and 8 | K1A/S45I/V54I/R55L/I57F/P59F/E60T/E61L/G110A/G147A/C242S/R248A/R251A | eliminated | | YES |
| 3, 4, 7, and 8 | S45I/V54I/R55L/I57F/P59F/E60T/E61L/T180G/T181I/D183G/D184F/L185D/S186F/G187T/C242S/R248A/R251A | eliminated | YES | |
| 3, 4, 5, 6, 7, and 8 | T45I/V54I/R55L/I57F/P59F/E60T/E61L/G110A/G147A/R188A/C242S/R248A/R251A | eliminated | | YES |
| 3, 4, 5, 6, 7, and 8 | S45I/V54I/R55L/I57F/P59F/E60T/E61L/G110A/G147A/R188A/C242S/R248A/R251A | eliminated | | YES |
| 1, 3, 4, 5, 6, 7, and 8 | K1A/T45I/V54I/R55L/I57F/P59F/E60T/E61L/G110A/G147A/R188A/C242S/R248A/ R251A | eliminated | | YES |
| 1, 3, 4, 5, 6, 7, and 8 | K1A/S45I/V54I/R55L/I57F/P59F/E60T/E61L/G110A/G147A/R188A/C242S/R248A/R251A | eliminated | | YES |
| 1, 3, 4, 5, 6, 7, and 8 | T4I/T45I/V54I/R55L/I57F/P59F/E60T/E61L/G110A/G147A/R188A/C242S/R248A/ R251A | eliminated | YES | YES |

TABLE 12-continued

Substitutions and Combinations of Substitutions Empirically Verified Not to Prevent Exhibition of a Potent Shiga Toxin Effector Function(s) natively positioned amino acid positions

| Epitope Region | Substitution(s) | Epitope Prediction | Ribosome Inhibition | Cytotoxicity |
|---|---|---|---|---|
| 1, 3, 4, 5, 6, 7, and 8 | T4I/S45I/V54I/R55L/I57F/P59F/E60T/E61L/G110A/G147A/R188A/C242S/R248A/ R251A | eliminated | YES | YES |
| 1, 3, 4, 5, 6, 7, and 8 | K1A/T4I/T45I/V54I/R55L/I57F/P59F/E60T/E61L/G110A/G147A/R188A/C242S/R248A/ R251A | eliminated | | YES |
| 1, 3, 4, 5, 6, 7, and 8 | K1A/T4I/S45I/V54I/R55L/I57F/P59F/E60T/E61L/G110A/G147A/R188A/C242S/R248A/R251A | eliminated | | YES |
| 1, 3, 4, 5, 6, 7, and 8 | T4I/T45I/D58A/E60I/G62A/G110A/G147A/D183A/D184A/R188A/C242S/R248A/R251A | eliminated | YES | YES |
| 1, 3, 4, 5, 6, 7, and 8 | T4I/S45I/D58A/E60I/G62A/G110A/G147A/D183A/D184A/R188A/C242S/R248A/R251A | eliminated | YES | YES |
| 3, 4, 5, 6, and 8 | T45I/V54I/R55L/I57F/P59F/E60T/E61L/G110A/G147A/▼ins 11 residues/C242S/R248A/R251A | eliminated | | YES |
| 3, 4, 5, 6, and 8 | S45I/V54I/R55L/I57F/P59F/E60T/E61L/G110A/G147A/▼ins 11 residues/C242S/R248A/R251A | eliminated | | YES |

In epitope regions 1-5 and 7-8, different amino acid substitutions have been made and tested (see Table 12). In epitope region #1 (see Table 7), the lysine natively located at position 1 in the mature A Subunits of Shiga-like toxin 1 (SEQ ID NO: 1) and Shiga toxin (SEQ ID NO: 2) was mutated to alanine (K1A) and methionine (K1M)). In epitope region #1, the threonine natively located at position 4 in the mature A Subunits of Shiga-like toxin 1 (SEQ ID NO: 1) and Shiga toxin (SEQ ID NO:2) was mutated to isoleucine (T4I). In epitope region #1, the aspartate natively located at position 6 in the mature A Subunits of Shiga-like toxin 1 (SEQ ID NO:1) and Shiga toxin (SEQ ID NO:2) was mutated to arginine (D6R). In epitope region #1, the serine natively located at position 8 in the mature A Subunits of Shiga-like toxin 1 (SEQ ID NO:1) and Shiga toxin (SEQ ID NO:2) was mutated to isoleucine (S8I). In epitope region #1, the threonine natively located at position 9 in the mature A Subunits of Shiga-like toxin 1 (SEQ ID NO:1) and Shiga toxin (SEQ ID NO:2) was mutated to isoleucine (T9I) and to valine (T9V). In epitope region #1, the lysine natively located at position 11 in the mature A Subunits of Shiga-like toxin 1 (SEQ ID NO:1) and Shiga toxin (SEQ ID NO:2) was mutated to alanine (K11A) and to histidine (K11H). In epitope region #1, the threonine natively located at position 12 in the mature A Subunits of Shiga-like toxin 1 (SEQ ID NO:1) and Shiga toxin (SEQ ID NO:2) was mutated to lysine (T12K).

In epitope region #2 (see Table 7), the serine natively located at position 33 in the mature A Subunits of Shiga-like toxin 1 (SEQ ID NO:1) and Shiga toxin (SEQ ID NO:2) was mutated to isoleucine (S33I).

In epitope region #3 (see Table 7), the serine natively located at position 43 in the mature A Subunit of Shiga-like toxin 1 (SEQ ID NO:1) was mutated to asparagine (S43N). In epitope region #3, the glycine natively located at position 44 in the mature A Subunit of Shiga-like toxin 1 (SEQ ID NO:1) was mutated to leucine (G44L). In epitope region #3, the serine natively located at position 45 in the mature A Subunit of Shiga-like toxin 1 (SEQ ID NO:1) was mutated to valine (S45V) and to isoleucine (S45I). In epitope region #3, the threonine natively located at position 45 in the mature A Subunit of Shiga-like toxin 1 (SEQ ID NO:2) was mutated to valine (T45V) and to isoleucine (T45I). In epitope region #3, the glycine natively located at position 46 in the mature A Subunit of Shiga-like toxin 1 (SEQ ID NO:1) was mutated to proline (G46P). In epitope region #3, the aspartate natively located at position 47 in the mature A Subunit of Shiga-like toxin 1 (SEQ ID NO:1) was mutated to glycine (D47G) and to methionine (D47M). In epitope region #3, the asparagine natively located at position 48 in the mature A Subunit of Shiga-like toxin 1 (SEQ ID NO:1) was mutated to valine (N48V) and to phenylalanine (N48F).

In epitope region #4 (see Table 7), the aspartate natively located at position 53 in the mature A Subunit of Shiga-like toxin 1 (SEQ ID NO:1) and Shiga toxin (SEQ ID NO:2) was mutated to alanine (D53A), glycine (D53G), and asparagine (D53N). The D53 residue was predicted by the Epitopia webserver to be solvent exposed and have an immunogenicity scale value of 5 or "high." In epitope region #4, the valine natively located at position 54 in the mature A Subunit of Shiga-like toxin 1 (SEQ ID NO:1) and Shiga toxin (SEQ ID NO:2) was mutated to isoleucine (V54I). In epitope region #4, the arginine natively located at position 55 in the mature A Subunit of Shiga-like toxin 1 (SEQ ID NO:1) and Shiga toxin (SEQ ID NO:2) was mutated to alanine (R55A), to valine (R55V), and to leucine (R55L). In epitope region #4, the glycine natively located at position 56 in the mature A Subunit of Shiga-like toxin 1 (SEQ ID NO:1) and Shiga toxin (SEQ ID NO:2) was mutated to proline (G56P). In epitope region #4, the isoleucine natively located at position 57 in the mature A Subunit of Shiga-like toxin 1 (SEQ ID NO:1) and Shiga toxin (SEQ ID NO:2) was mutated to methionine (D57M) and to phenylalanine (D57F). In epitope region #4, the aspartate natively located at position 58 in the mature A Subunit of Shiga-like toxin 1 (SEQ ID NO:1) and Shiga toxin (SEQ ID NO:2) was mutated to alanine (D58A), to valine (D58V), and to phenylalanine (D58F). In epitope region #4, the proline natively located at position 59 in the mature A Subunit of Shiga-like toxin 1 (SEQ ID NO:1) and Shiga toxin (SEQ ID NO:2) was mutated to alanine (P59A). In epitope region #4, the glutamate natively located at position 60 in the mature A Subunit of Shiga-like toxin 1 (SEQ ID NO:1) and Shiga toxin (SEQ ID NO:2) was mutated to isoleucine (E60I), to threonine (E60T), and to arginine (E60R). In epitope region #4, the glutamate natively located at position 61 in the mature A Subunit of Shiga-like toxin 1 (SEQ ID NO:1) and Shiga toxin (SEQ ID NO:2) was mutated to alanine (E61A), to valine (E61V), and to leucine (E61L). In epitope region #4, the glycine natively located at position 62 in the mature A Subunit of Shiga-like toxin 1 (SEQ ID NO:1) and Shiga toxin (SEQ ID NO:2) was mutated to alanine (G62A).

In epitope region #5 (see Table 7), the aspartate natively located at position 94 in the mature A Subunit of Shiga-like toxin 1 (SEQ ID NO:1) and Shiga toxin (SEQ ID NO:2) was mutated to alanine (D94A). In epitope region #5, the serine natively located at position 96 in the mature A Subunit of Shiga-like toxin 1 (SEQ ID NO:1) and Shiga toxin (SEQ ID NO:2) was mutated to isoleucine (S96I). In epitope region #5, the threonine natively located at position 104 in the mature A Subunit of Shiga-like toxin 1 (SEQ ID NO:1) and Shiga toxin (SEQ ID NO:2) was mutated to asparagine (T104N). In epitope region #5, the alanine natively located at position 105 in the mature A Subunit of Shiga-like toxin 1 (SEQ ID NO:1) and Shiga toxin (SEQ ID NO:2) was mutated to leucine (A105L). In epitope region #5, the threonine natively located at position 107 in the mature A Subunit of Shiga-like toxin 1 (SEQ ID NO:1) and Shiga toxin (SEQ ID NO:2) was mutated to proline (T107P). In epitope region #5, the leucine natively located at position 108 in the mature A Subunit of Shiga-like toxin 1 (SEQ ID NO:1) and Shiga toxin (SEQ ID NO:2) was mutated to methionine (L108M). In epitope region #5, the serine natively located at position 109 in the mature A Subunit of Shiga-like toxin 1 (SEQ ID NO:1) and Shiga toxin (SEQ ID NO:2) was mutated to valine (S109V). In epitope region #5, the glycine natively located at position 110 in the mature A Subunit of Shiga-like toxin 1 (SEQ ID NO:1) and Shiga toxin (SEQ ID NO:2) was mutated to alanine (G110A). In epitope region #5, the aspartate natively located at position 111 in the mature A Subunit of Shiga-like toxin 1 (SEQ ID NO:1) and Shiga toxin (SEQ ID NO:2) was mutated to threonine (D111T). In epitope region #5, the serine natively located at position 112 in the mature A Subunit of Shiga-like toxin 1 (SEQ ID NO:1) and Shiga toxin (SEQ ID NO:2) was mutated to valine (S112V).

In epitope region #6 (see Table 7), the aspartate natively located at position 141 in the mature A Subunit of Shiga-like toxin 1 (SEQ ID NO:1) and Shiga toxin (SEQ ID NO:2) was mutated to alanine (D141A). In epitope region #6, the glycine natively located at position 147 in the mature A Subunit of Shiga-like toxin 1 (SEQ ID NO:1) and Shiga toxin (SEQ ID NO:2) was mutated to alanine (G147A).

In epitope region #7 (see Table 7), the arginine natively located at position 179 in the mature A Subunit of Shiga-like toxin 1 (SEQ ID NO:1) and Shiga toxin (SEQ ID NO:2) was mutated to alanine (R179A). This R179 residue was predicted by the Epitopia webserver to be exposed and have an immunogenicity value of 5 or "high." In epitope region #7 (see Table 7), the threonine natively located at position 180 in the mature A Subunit of Shiga-like toxin 1 (SEQ ID NO:1) and Shiga toxin (SEQ ID NO:2) was mutated to glycine (T180G). In epitope region #7 (see Table 7), the threonine natively located at position 181 in the mature A Subunit of Shiga-like toxin 1 (SEQ ID NO:1) and Shiga toxin (SEQ ID NO:2) was mutated to isoleucine (T181I). In epitope region #7 (see Table 7), the aspartate natively located at position 183 in the mature A Subunit of Shiga-like toxin 1 (SEQ ID NO:1) and Shiga toxin (SEQ ID NO:2) was mutated to alanine (D183A) and to glycine (D183G). In epitope region #7, the aspartate natively located at position 184 in the mature A Subunit of Shiga-like toxin 1 (SEQ ID NO:1) and Shiga toxin (SEQ ID NO:2) was mutated to alanine (D184A) or phenylalanine (D184F). In epitope region #7 (see Table 7), the leucine natively located at position 185 in the mature A Subunit of Shiga-like toxin 1 (SEQ ID NO:1) and Shiga toxin (SEQ ID NO:2) was mutated to valine (L185V) or aspartate (L185D). In epitope region #7, the serine natively located at position 186 in the mature A Subunit of Shiga-like toxin 1 (SEQ ID NO:1) and Shiga toxin (SEQ ID NO:2) was mutated to alanine (S186A) and to phenylalanine (S186F). In epitope region #7, the glycine natively located at position 187 in the mature A Subunit of Shiga-like toxin 1 (SEQ ID NO:1) and Shiga toxin (SEQ ID NO:2) was mutated to alanine (G187A) and to threonine (G187T). In epitope region #7, the arginine natively located at position 188 in the mature A Subunit of Shiga-like toxin 1 (SEQ ID NO:1) and Shiga toxin (SEQ ID NO:2) was mutated to alanine (R188A) and to leucine (R188L). In epitope region #7, the serine natively located at position 189 in the mature A Subunit of Shiga-like toxin 1 (SEQ ID NO:1) and Shiga toxin (SEQ ID NO:2) was mutated to alanine (S189A).

In epitope region #8 (see Table 7), the arginine natively located at position 248 in the mature A Subunit of Shiga-like toxin 1 (SEQ ID NO:1) and Shiga toxin (SEQ ID NO:2) was mutated to alanine (R248A). In epitope region #8, the arginine natively located at position 251 in the mature A Subunit of Shiga-like toxin 1 (SEQ ID NO:1) and Shiga toxin (SEQ ID NO:2) was mutated to alanine (R251A).

The leucine natively located at position 49 in the mature A Subunit of Shiga-like toxin 1 (SEQ ID NO:1) and Shiga toxin (SEQ ID NO:2) was mutated to alanine (L49A). This L49 residue was predicted by the Epitopia webserver to be solvent exposed and have an immunogenicity value of 4 and is present in T-cell epitope #2 (see Table 7). The glutamate natively located at position 198 in the mature A Subunit of Shiga-like toxin 1 (SEQ ID NO:1) and Shiga toxin (SEQ ID NO:2) was mutated to alanine (D198A). This D198 residue was predicted by the Epitopia webserver to be solvent exposed and have an immunogenicity value of 5 or "high." The arginine natively located at position 205 in the mature A Subunit of Shiga-like toxin 1 (SEQ ID NO:1) and Shiga toxin (SEQ ID NO:2) was mutated to alanine (R205A). This R205 residue was predicted by the Epitopia webserver to be solvent exposed and have an immunogenicity value of 5 or "high."

In T-cell epitopes #1 through #6, different amino acid substitutions have been made and tested (see Table 12).

In T-cell epitope #1 (see Table 7), the threonine natively located at position 4 in the mature A Subunits of Shiga-like toxin 1 (SEQ ID NO:1) and Shiga toxin (SEQ ID NO:2) was mutated to isoleucine (T4I), the aspartate natively located at position 6 in the mature A Subunits of Shiga-like toxin 1 (SEQ ID NO:1) and Shiga toxin (SEQ ID NO:2) was mutated to arginine (D6R), the serine natively located at position 8 in the mature A Subunits of Shiga-like toxin 1 (SEQ ID NO:1) and Shiga toxin (SEQ ID NO:2) was mutated to isoleucine (S8I), the threonine natively located at position 9 in the mature A Subunits of Shiga-like toxin 1 (SEQ ID NO:1) and Shiga toxin (SEQ ID NO:2) was mutated to isoleucine (T9I) and to valine (T9V), the lysine natively located at position 11 in the mature A Subunits of Shiga-like toxin 1 (SEQ ID NO:1) and Shiga toxin (SEQ ID NO:2) was mutated to alanine (K11A) and to histidine (K11H), the threonine natively located at position 12 in the mature A Subunits of Shiga-like toxin 1 (SEQ ID NO:1) and Shiga toxin (SEQ ID NO:2) was mutated to lysine (T12K), and the serine natively located at position 33 in the mature A Subunits of Shiga-like toxin 1 (SEQ ID NO:1) and Shiga toxin (SEQ ID NO:2) was mutated to isoleucine (S33I).

In T-cell epitope #2 (see Table 7), the serine natively located at position 43 in the mature A Subunit of Shiga-like toxin 1 (SEQ ID NO:1) was mutated to asparagine (S43N); the glycine natively located at position 44 in the mature A Subunit of Shiga-like toxin 1 (SEQ ID NO:1) was mutated to leucine (G44L); the serine natively located at position 45 in the mature A Subunit of Shiga-like toxin 1 (SEQ ID NO:1) was mutated to valine (S45V) and to isoleucine (S45I); the glycine natively located at position 46 in the mature A Subunit of Shiga-like toxin 1 (SEQ ID NO:1) was mutated to proline (G46P); the aspartate natively located at position 47 in the mature A Subunit of Shiga-like toxin 1 (SEQ ID NO:1) was mutated to glycine (D47G) and to methionine (D47M); the asparagine natively located at position 48 in the mature A Subunit of Shiga-like toxin 1 (SEQ ID NO:1) was mutated to valine (N48V) and to phenylalanine (N48F); the phenylalanine natively located at position 50 in the mature A Subunit of Shiga-like toxin 1 (SEQ ID NO:1) and Shiga toxin (SEQ ID NO:2) was mutated to alanine (F50T); the alanine natively located at position 51 in the mature A Subunit of Shiga-like toxin 1 (SEQ ID NO:1) and Shiga toxin (SEQ ID NO:2) was mutated to valine (A51V); the aspartate natively located at position 53 in the mature A Subunit of Shiga-like toxin 1 (SEQ ID NO:1) and Shiga toxin (SEQ ID NO:2) was mutated to alanine (D53A), glycine (D53G), and asparagine (D53N); the valine natively located at position 56 in the mature A Subunit of Shiga-like toxin 1 (SEQ ID NO:1) and Shiga toxin (SEQ ID NO:2) was mutated to leucine (V54L); the arginine natively located at position 55 in the mature A Subunit of Shiga-like toxin 1 (SEQ ID NO:1) and Shiga toxin (SEQ ID NO:2) was mutated to alanine (R55A), to valine (R55V), and to leucine (R55L); the glycine natively located at position 56 in the mature A Subunit of Shiga-like toxin 1 (SEQ ID NO:1) and Shiga toxin (SEQ ID NO:2) was mutated to proline (G56P); the isoleucine natively located at position 57 in the mature A Subunit of Shiga-like toxin 1 (SEQ ID NO:1) and Shiga toxin (SEQ ID NO:2) was mutated to methionine (D57M) and to phenylalanine (D57F); the aspartate natively located at position 58 in the mature A Subunit of Shiga-like toxin 1 (SEQ ID NO:1) and Shiga toxin (SEQ ID NO:2) was mutated to alanine (D58A), to valine (D58V), and to phenylalanine (D58F); the proline natively located at position 59 in the mature A Subunit of Shiga-like toxin 1 (SEQ ID NO:1) and Shiga toxin (SEQ ID NO:2) was mutated to alanine (P59A); the glutamate natively located at position 60 in the mature A Subunit of Shiga-like toxin 1 (SEQ ID NO:1) and Shiga toxin (SEQ ID NO:2) was mutated to isoleucine (E60I), to threonine (E60T), and to arginine (E60R); the glutamate natively located at position 61 in the mature A Subunit of Shiga-like toxin 1 (SEQ ID NO:1) and Shiga toxin (SEQ ID NO:2) was mutated to alanine (E61A), to valine (E61V), and to leucine (E61L); the glycine natively located at position 62 in the mature A Subunit of Shiga-like toxin 1 (SEQ ID NO:1) and Shiga toxin (SEQ ID NO:2) was mutated to alanine (G62A).

In T-cell epitope #3 (see Table 7), the aspartate natively located at position 94 in the mature A Subunit of Shiga-like toxin 1 (SEQ ID NO:1) and Shiga toxin (SEQ ID NO:2) was mutated to alanine (D94A), and the serine natively located at position 96 in the mature A Subunit of Shiga-like toxin 1 (SEQ ID NO:1) and Shiga toxin (SEQ ID NO:2) was mutated to isoleucine (S96I).

In T-cell epitope #4 (see Table 7), the glycine natively located at position 147 in the mature A Subunit of Shiga-like toxin 1 (SEQ ID NO:1) and Shiga toxin (SEQ ID NO:2) was mutated to alanine (G147A).

In T-cell epitope #5 (see Table 7), the arginine natively located at position 179 in the mature A Subunit of Shiga-like toxin 1 (SEQ ID NO:1) and Shiga toxin (SEQ ID NO:2) was mutated to alanine (R179A), the threonine natively located at position 180 in the mature A Subunit of Shiga-like toxin 1 (SEQ ID NO:1) and Shiga toxin (SEQ ID NO:2) was mutated to glycine (T180G), the threonine natively located at position 181 in the mature A Subunit of Shiga-like toxin 1 (SEQ ID NO:1) and Shiga toxin (SEQ ID NO:2) was mutated to isoleucine (T181I), and the aspartate natively located at position 183 in the mature A Subunit of Shiga-like toxin 1 (SEQ ID NO:1) and Shiga toxin (SEQ ID NO:2) was mutated to alanine (D183A) and to glycine (D183G).

In T-cell epitope #6 (see Table 7), the cysteine natively located at position 242 in the mature A Subunit of Shiga-like toxin 1 (SEQ ID NO:1) and Shiga toxin (SEQ ID NO:2) was mutated to serine (C242S), the arginine natively located at position 248 in the mature A Subunit of Shiga-like toxin 1 (SEQ ID NO:1) and Shiga toxin (SEQ ID NO:2) was mutated to alanine (R248A), and the arginine natively located at position 251 in the mature A Subunit of Shiga-like toxin 1 (SEQ ID NO:1) and Shiga toxin (SEQ ID NO:2) was mutated to alanine (R251A).

Furthermore, truncating the carboxy-terminus of SLT-1A to amino acids 1-251 of SEQ ID NO: 1 removed the last two epitope regions (Table 7, #9 and #10), the last CD4+ T-cell epitope (Table 6, #7), and the highest scoring discontinuous, B-cell epitope predicted by ElliPro (289-293). In addition, the truncation at position 251 disrupts T-cell epitope #6 and epitope region #8 (Table 7).

An exemplary, de-immunized, Shiga toxin effector polypeptide of this Example is SLT-1A-combo22 (SEQ ID NO:28), which has seven, amino acid residue substitutions relative to the wild-type Shiga-like toxin 1 A Subunit (SEQ ID NO:1) and all of these substitutions were predicted to disrupt endogenous epitopes. In accord with the labels in Table 8, the Shiga toxin effector polypeptide SLT-1A-combo22 comprises a substitution disrupting epitope region 4; a substitution disrupting epitope region 5; a substitution disrupting epitope region 6; a substitution disrupting epitope region 7; substitutions disrupting epitope region 8; epitope regions 8, 9, and 10 disrupted by truncation; and substitutions disrupting the furin-cleavage site at the carboxy-terminus of the A1 fragment-derived region. In addition, SLT-1A-combo22 comprises a substitution disrupting T-cell epitope #2, a substitution disrupting T-cell epitope #4, substitutions disrupting epitope #6, and T-cell epitopes #6 and #7 disrupted by truncation.

E. Testing for Reductions in Antigenicities of Exemplary, Shiga Toxin Effector Polypeptides SLT-1A-Combo(n) Using ELISA and Western Blot Assays Routine methods may be used to evaluate the relative antigenicities of Shiga toxin effector polypeptides in the context of cell-targeting molecules (see e.g. WO 2015/113005; WO 2015/113007). The antigenicities of exemplary, cell-targeting molecules comprising certain, combination, de-immunized, protease-cleavage resistant, Shiga toxin effector polypeptides SLT-1A-combo(n) was assessed by Western blots and ELISAs using both polyclonal and monoclonal antibodies that bind with high-affinity to the wild-type Shiga-like toxin A1 fragment (SLT-1A1). The cell-targeted molecule SLT-1A-FR::scFv-1 (SEQ ID NO:34) was used as a reference molecule.

The Western analyses used herein determined relative antigenicity under denaturing conditions whereas the ELISA analyses used herein measured relative antigenicity under native protein folding conditions.

For Western analyses, exemplary, cell-targeting molecules comprising the Shiga toxin effector polypeptides SLT-1A-combo7, SLT-1A-combo10, or SLT-1A-combo14 were tested and compared to the results for the reference molecule SLT-1A-FR::scFv-1. Samples of the aforementioned molecules were loaded in equal amounts to replicate, 4-20% SDS polyacrylamide gels (Lonza, Basel, CH) and electrophoresed under denaturing conditions. The resulting gels were either analyzed by Coomassie staining or transferred to polyvinyl difluoride (PVDF) membranes using the iBlot® (Life Technologies, Carlsbad, Calif., U.S.) system according to manufacturer's instructions. The resulting membranes were probed under standard conditions using the following antibodies: mouse monoclonal α-Stx (mAb1) (BEI NR-867 BEI Resources, Manassas, Va., U.S.; cross reactive with the Shiga-like toxin 1 A Subunit), rabbit polyclonal antibody α-SLT-1A (pAb1) (Harlan Laboratories, Inc. Indianapolis, Ind., U.S., custom antibody production raised against the wild-type SLT-1A1, and rabbit polyclonal antibody α-SLT-1A (pAb2) (Genscript, Piscataway, N.J., U.S., custom antibody production) which was raised against peptides from the wild-type Shiga toxin A1 fragment: RGIDPEEGRFNN (SEQ ID NO: 593) and HGQDSVRVGR (SEQ ID NO: 594). The peptide sequence RGIDPEEGRFNN (SEQ ID NO: 593) is located at amino acids 55-66 and the peptide sequence HGQDSVRVGR (SEQ ID NO: 594) is located at 214-223 in SLT-1A and StxA. Membrane bound antibodies were detected using standard conditions and, when appropriate, using horseradish peroxidase (HRP)-conjugated secondary antibodies (goat anti-rabbit-HRP or goat anti-mouse-HRP, Thermo Scientific, Rockford, Ill., U.S.). FIG. 13 shows Western blots with the lanes of the gels and/or membranes numbered and the figure legend indicating by the same respective numbering which Shiga toxin effector polypeptide regions were present in the cell-targeting molecule loaded into each lane. Coomassie stained lanes are shown as sample loading controls.

FIG. 13 shows that, under denaturing conditions, exemplary cell-targeting molecules SLT-1A-combo7::scFv-1, SLT-1A-combo10::scFv-1, and SLT-1A-combo14::scFv-1 exhibit decreased antigenicities as compared to SLT-1A-FR::scFv-1 in this assay. These results demonstrate that SLT-1A-combo7, SLT-1A-combo10, and SLT-1A-combo14 have decreased antigenicities as compared to SLT-1A-FR, or by inference to SLT-1A-WT, when linked by the same fashion to the same targeting domain (scFv-1) using the same linker. Additionally, the results shown in FIG. 13 suggest that SLT-1A-combo7 has reduced relative antigenicity as compared to SLT-1A-combo10 and SLT-1A-combo14 in this assay under the conditions tested.

A standard ELISA was used to measure the ability of α-SLT-1A mAb1 to recognize various de-immunized, Shiga toxin effector polypeptides, each with multiple epitope regions disrupted, in the context of a cell-targeting molecule. The ability of each cell-targeting molecule tested to bind the target biomolecule of its scFv binding region was utilized in the assay. The wells of Nunc MaxiSorp® plates in phosphate buffered saline (1×PBS) (Hyclone Brand, Fisher Scientific, Waltham, Mass., U.S.) were coated with recombinant, human target biomolecule of the binding region (scFv-1). The plates were incubated overnight at 4° C. The wells were washed with 1×PBS 0.05% Tween-20 (PBS-T), and non-specific binding was blocked by incubating the wells with 3% milk in PBS-T for one hour at room temperature. Exemplary cell-targeting molecules were added to the wells, where certain wells received only one cell-targeting molecule comprising only one, combination, de-immunized, Shiga toxin effector polypeptide SLT-1A-combo(n): SLT-1A-combo7::scFv-1, SLT-1A-combo10::scFv-1, or SLT-1A-combo14::scFv-1. In addition, the cell-targeted molecule SLT-1A-FR::scFv-1 was added to certain wells as a reference molecule. All cell-targeting molecules were added to the wells at a concentration determined to be above the maximum binding (Bmax) determined previously with an ELISA using Protein L conjugated to HRP to detect SLT-1A-FR::scFv-1, thus allowing for 100% of the available target biomolecules to be bound by the cell-targeting molecule sample, which is in excess. The plates were incubated at room temperature for one hour to allow for cell-targeting molecule to bind to target biomolecule under non-denaturing conditions. The wells were washed with PBS-T and then incubated with anti-SxtA mouse monoclonal antibody conjugated to HRP (anti-SLT-1A mAb1-RP) or rabbit polyclonal antibody α-SLT-1A conjugated to HRP (anti-SLT-1A pAb2-RP) or protein L-HRP (which binds to scFv-1 and was used as a loading control) for 1 hour at room temperature. The wells were washed in PBS-T then incubated with Pierce TMB Ultra (Thermo Scientific Inc., Rockford, Ill., U.S.). The reactions were stopped with 250 mM hydrochloric acid (HCl). HRP activity was detected in the wells by adding a chromogenic HRP substrate and then detecting light emission, resulting from chemiluminscence, using a plate reading device measuring absorbance (Abs) of light set to the wavelength of 450 nanometers (nm).

The measured absorbance values were corrected for background by subtracting the absorbance values for coated, blocked wells incubated with only PBS instead of any cell-targeting molecule sample. To normalize the signals from the three different, detection antibodies, the signals from SLT-1A-FR::scFv1 was set at 100%, and the relative signals as a percentage of this control were determined for each cell-targeting molecule sample tested by the calculation (Abs signal of the sample/Average Abs signal of the control)×100. The ELISA results are shown in FIG. 14.

FIG. 14 shows that, under native conditions, the exemplary cell-targeting molecules SLT-1A-combo7::scFv-1 (SEQ ID NO:44), SLT-1A-combo10::scFv-1 (SEQ ID NO:47), or SLT-1A-combo14::scFv-1 (SEQ ID NO:50) exhibit decreased antigenicities as compared to SLT-1A-FR::scFv-1 (SEQ ID NO:34). These results demonstrate that SLT-1A-combo7, SLT-1A-combo10, and SLT-1A-combo14 exhibit decreased antigenicities as compared to SLT-1A-FR (SEQ ID NO:5), or by inference or SLT-1A1-WT (SEQ ID NO:4), when linked by the same fashion to the same targeting domain (scFv-1) using the same linker. Additionally, the results shown in FIG. 14 suggest that SLT-1A-combo7 and SLT-1A-combo14 have reduced relative antigenicities as compared to SLT-1A-combo10 under the native conditions of this ELISA assay.

F. Testing the CD4+ T-Cell De-Immunization of Exemplary, Shiga Toxin Effector Polypeptides SLT-1A-Combo(n)

Disruptions in predicted CD4+ T-cell epitope regions are tested for reductions in CD4+ T-cell immunogenicity using assays of human CD4+ T-cell proliferation in the presence of exogenously administered polypeptides and assays of human CD4+ dendritic T-cell stimulation in the presence of human monocytes treated with administered polypeptides.

T-cell proliferation assays known to the skilled worker are used to test the effectiveness of CD4+ T-cell epitope de-immunization of Shiga toxin effector polypeptides SLT-1A-combo(n). The T-cell proliferation assay of this Example involves the labeling of CD4+ T-cells and then measuring changes in proliferation using flow cytometric methods in response to the administration of different peptides derived from either a Shiga toxin effector polypeptide combo(n) or a reference molecule, such as, e.g., a wild-type Shiga toxin A1 fragment, SLT-1A-FR, and/or a related cell-targeting molecule comprising the aforementioned.

A series of overlapping peptides derived from the chosen molecule are synthesized and tested in the CFSE CD4+ T cell proliferation assay (ProImmune Inc., Sarasota, Fla., U.S). Human CD8+ T-cell depleted, peripheral blood mononuclear cells (PBMCs) labeled with CFSE are cultured with 5 pM of each peptide of interest for seven days in six replicate wells. Each assay plate includes a set of untreated control wells. The assay also incorporates reference antigen controls, comprising synthetic peptides for known MHC class II antigens or agretopes.

The CD8+ T-cell depleted, PBMCs that proliferate in response to an administered peptide will show a reduction in CFSE fluorescence intensity as measured directly by flow cytometry. For a naïve T-cell analysis, the Percentage Stimulation above background is determined for each stimulated sample, through comparison with results from an unstimulated sample, such as by ranking with regard to fluorescent signal, as negative, dim, or high. Counts for the CD4+ CFSE T-cell dim population in each sample are expressed as a proportion of the total CD4+ T-cell population. The replicate values are used to calculate Percentage Stimulation above Background (proportion of CD4+ T-cell CFSE dim cells with antigen stimulation, minus proportion of CD4+ T-cell CFSE dim cells without antigen stimulation). The mean and standard error of the mean are calculated from the replicate values. A result is considered "positive" if the Percentage Stimulation above background is greater than 0.5% and also greater than twice the standard error above background. To allow for comparison of peptides, a Response Index is calculated. This index is based on multiplying the magnitude of response (Percentage Stimulation above background) for each peptide by the number of responding donors (Percentage Antigenicity) for each peptide.

G. Determining the Relative, CD4+ T-Cell Immunogenicities of Exemplary, Shiga Toxin Effector Polypeptides SLT-1A-Combo(n)

The relative CD4+ T-cell immunogenicity of molecules of the invention is determined using the following dendritic cell (DC) T-cell proliferation assay. This DC T-cell assay measures CD4+ T-cell responses to exogenously administered polypeptides or proteins. The DC T-cell assay is performed using ProImmune's DC-T assay service to determine the relative levels of CD4+ T-cell driven immunogenicity between proteins and cell-targeting molecules of the present invention as compared to reference molecules. The DC T-cell assay of this Example involves testing human dendritic cells for antigen presentation of peptides derived from the administered polypeptide, protein, or cell-targeting molecule samples.

Briefly, healthy human donor tissues are used to isolate typed samples based on high-resolution MHC class II tissue-typing. A cohort of 20, 40 or 50 donors is used. First, monocytes obtained from human donor PBMCs are cultured in a defined medium to generate immature dendritic cells. Then, the immature dendritic cells are stimulated with a well-defined control antigen and induced into a more mature phenotype by further culture in a defined medium. Next, CD8+ T-cell depleted donor PBMCs from the same human donor sample are labeled with CFSE. The CFSE-labeled, CD8+ T-cell depleted PBMCs are then cultured with the antigen-primed, dendritic cells for seven days to allow for CD4+ dendritic cell stimulation, after which eight replicates for each sample are tested. As negative controls, each dendritic cell culture series also includes a set of untreated dendritic cells. For a positive control, the assay incorporates two well-defined reference antigens, each comprising a full-length protein.

To evaluate dendritic cell based immunogenicity, the frequency of donor cell responses is analyzed across the study cohort. Positive responses in the assay are considered indicative of a potential in vivo CD4+ T-cell response. A positive response, measured as a percentage of stimulation above background, is defined as percentages greater than 0.5 percent (%) in two or more independent donor samples. The strength of positive donor cell responses is determined by taking the mean percentage stimulation above background obtained across accepted donors for each sample. A Response Index is calculated by multiplying the value of the strength of response by the frequency of the donors responding to determine levels of CD4+ T-cell immunogenicity for each sample. In addition, a Response index, representing the relative CD4+ T-cell immunogenicity is determined by comparing the results from two samples, one involving a Shiga Toxin Effector Polypeptides SLT-1A-combo(n) and a second variant which is a related molecule that lacks one or more predicted disruptions of a CD4+ T-cell epitope and/or epitope region as a reference molecule.

H. Testing for Reductions in Immunogenicities of Exemplary, Cell-Targeting Molecules Comprising Shiga Toxin Effector Polypeptides SLT-1A-Combo(n)

Mice were used to investigate the immunogenic potential of certain exemplary molecules of the present invention. The relative immunogenicities of exemplary cell-targeting molecules were determined using an assay for in vivo antibody responses to the cell-targeting molecules after repeat, parenteral administrations over periods of many weeks (see e.g. WO 2015/113005). An in-solution ELISA was used to determine the relative amount of serum murine antibodies that were specific to different cell-targeting molecules. This immunogenicity assay involves the use of mice which are indicative of the relative immunogenicities of molecules in mammals generally.

This assay was used to determine the relative immunogenicity of exemplary cell-targeting molecules comprising SLT-1A-combo(n)::scFv-(n) as compared to the less de-immunized, cell-targeted molecule SLT-1A-FR::scFv(n) or to the reference molecule scFv-3::SLT-1A-WT (SEQ ID NO:33). The reference molecule scFv-3::SLT-1A-WT was constructed in the reverse, amino-carboxy fusion orientation of the exemplary cell-targeting molecules of the present invention tested in the relative immunogenicity assay, and the Shiga toxin effector polypeptide component of scFv-3::SLT-1A-WT consisted of a wild-type Shiga toxin A1 fragment (SEQ ID NO:4), which represents an "un-de-immunized" Shiga toxin effector polypeptide.

Four different mouse studies were conducted where BALB/c or C57BL/6 mice were randomly assigned to treatment groups consisting of six mice per group and where the mice in different treatment groups were administered different cell-targeting molecules. First, serum samples were collected from each mouse prior to exposure to a cell-targeting molecule. Next, each mouse in a treatment group was administered 0.25 milligram of the sample molecule per kilogram of body weight (mg/kg) per dose of the sample cell-targeting molecule by intra-peritoneal injection three times a week for two weeks. After a week without administration of any samples, intra-peritoneal injections of 0.25 mg/kg per dose of the sample cell-targeting molecule were administered three times a week for an additional two weeks, resulting in a total of 12 doses of cell-targeting molecule over a five-week interval. For all studies, the administrated molecules SLT-1A-combo1::scFv-1 (SEQ ID NO:43), SLT-1A-combo7::scFv-1 (SEQ ID NO:44), SLT-1A-combo10::scFv-1 (SEQ ID NO:47), SLT-1A-combo10::scFv-2 (SEQ ID NO:61), SLT-1A-combo12::scFv-1 (SEQ ID NO:49), SLT-1A-combo15::scFv-1 (SEQ ID NO:51), SLT-1A-combo16::scFv-1 (SEQ ID NO:52), SLT-1A-combo19::scFv-1 (SEQ ID NO:55), SLT-1A-combo22::scFv-2 (SEQ ID NO:63), and the reference molecules SLT-1A-FR::scFv-1 (SEQ ID NO:34) and SLT-1A-FR::scFv-2 (SEQ ID NO:35) were well-tolerated, resulting in no or only minimal effects on body weight and no clinical signs. During and after the five-week administration interval, sera were collected from all the mice to observe antibodies targeting the administered cell-targeting molecules using in-solution ELISAs. The mouse studies were done at Charles River Laboratories in Piedmont, N.C., U.S. The results of these studies are shown in Tables 13-16 and FIGS. 15-16.

The in-solution ELISAs to detect antibodies recognizing the administered cell-targeting molecules were specific to the binding region scFv-(n) of the cell-targeting molecule being tested and performed as follows. For each cell-targeting molecule and its respective mouse-treatment group, a different ELISA assay was performed but using the same general in-solution ELISA assay setup. For each cell-targeting molecule and its respective mouse-treatment group, the in-solution ELISA assay setup involved only the appropriate target biomolecule of the scFv-(n) of the cell-targeting molecule of that group. For all in-solution ELISA assays, the ELISA plate wells were coated with a target biomolecule of the cell-targeting, binding region scFv-(n). The same cell-targeting molecule used for injections in a mouse-treatment group was incubated overnight at 4° C. in solution with the serum collected from a single mouse from that group, and then any complexes formed (e.g. complexes comprising the cell-targeting molecule and antibodies present in the serum) were captured using the coated ELISA plate wells. Captured, immune complexes comprising murine, immunoglobulin G molecules (IgGs) were detected using an anti-mouse IgG, secondary antibody conjugated to horseradish peroxidase. HRP activity was detected in the wells by adding a chromogenic HRP substrate and then detecting light emission as a result of chemiluminscence. The reaction was stopped by the addition of HCl, and HRP activity or "ELISA signal" was measured as at 450 nM using a plate reader. ELISA signal values were calculated as Absorbance values (Abs 450 nM) after subtracting the background signal as measured from "no serum" negative control wells. Serum was diluted to allow for Absorbance value readings below the level of saturation for the assay, and the dilution ratio was the same for all mice in all treatment groups measured on a given day. For the general setup of these in-solution ELISA assays, larger ELISA signal values indicate the presence of more murine IgG antibodies recognizing the administered cell-targeting molecule or in other words greater immunogenicity.

Based on these in-solution ELISA assays, none of the mice in any treatment group of the four studies were observed to have pre-formed serum antibodies recognizing the cell-targeting molecules tested prior to exposure via injection. Thus, any post-administration detection of anti-"cell-targeting molecule" IgG antibodies in the sera of the mice of these studies using the in-solution ELISA assay represents de novo, antibody production induced after the administration of a cell-targeting molecule.

Murine IgG antibody responses to the administered cell-targeting molecules were measured in the four studies at different time-points using the appropriate in-solution ELISA assays, and the results are reported in Tables 13-16 and FIGS. 15-16. At each time-point, serum samples were diluted such that the ELISA signal values remained within the dynamic range of the assay. For a single time-point in an individual study, all serum samples were diluted identically. The average ELISA Absorbance values for each mouse-treatment group at individual serum collection time-points ("average ELISA signal") were calculated. In conducting these relative immunogenicity studies, the same cell-targeting molecule injected into the mice of a particular treatment group was used in the ELISA assay to capture sera antibodies from sera collected only from the mice of that same group. In other words, anti-"cell-targeting molecule" IgG antibodies present in the sera from mice administered SLT-1A-FR::scFv-1 (the SLT-1A-FR::scFv-1 reference group) were captured and detected in an ELISA assay designed specifically and only with SLT-1A-FR::scFv-1, and, similarly, anti-"cell-targeting molecule" IgG antibodies present in the sera from mice administered SLT-1A-combo7::scFv-1 (e.g. the SLT-1A-combo7::scFv-1 group) were captured and detected using an in-solution ELISA assay designed specifically and only with SLT-1A-combo7::scFv-1.

The average ELISA signal values for each mouse-treatment group at individual serum collection time-points were calculated, and then the relative immunogenicity was calculated for each group at each time-point relative to the average ELISA Absorbance value at the same respective time-point for the reference group treated with the reference cell-targeting molecule as described above. The relative immunogenicity of each, tested, exemplary cell-targeting molecule (SLT-1A-combo(n)::scFv-(n)) in a given study at a certain time-point as compared to the immunogenicity of a reference molecule (e.g., SLT-1A-FR::scFv-(n) or scFv-3::SLT-1A-WT) was calculated using the formula: (ELISA signal of cell-targeting molecule–average ELISA signal of "no serum" control)/(average ELISA signal of reference molecule–average ELISA signal of "no serum" control)×100. To create FIGS. 15-16, the percentage of the reference molecule ELISA signal for each mouse-treatment group was graphed on the Y-axis, and the day of serum collection was graphed on the X-axis. To measure mammalian IgG responses to each cell-targeting molecule, the average ELISA signal ("avg signal") and the percent of the avg signal of the reference molecule SLT-1A-FR::scFv-(n) ("percent of ref") were calculated for each mouse-treatment group (Tables 13-16).

The results of the relative immunogenicity assays from the first mouse study are presented in FIG. 15-panel A and Table 13. The term "N/A" was used to indicate "not applicable" because calculations at Day 1 involved pre-treatment serum with ELISA signal values of zero.

TABLE 13

Relative Immunogenicities of the Exemplary, Cell-Targeting Molecule SLT-1A-combo7::scFv-1 Compared to SLT-1A-FR::scFv-1

| Day of serum collection | SLT-1A-combo7::scFv-1 avg ELISA signal | SLT-1A-combo7::scFv-1 percentage of reference | Reference SLT-1A-FR::scFv-1 avg ELISA signal | Reference SLT-1A-FR::scFv-1 percentage of reference |
|---|---|---|---|---|
| 1 | 0 | N/A | 0 | 100 |
| 15 | 0.02 | 3.90% | 0.49 | 100 |
| 22 | 0.10 | 11.20% | 0.87 | 100 |
| 29 | 0.20 | 27.30% | 0.73 | 100 |
| 36 | 0.33 | 35.60% | 0.93 | 100 |
| 43 | 0.20 | 24.60% | 0.80 | 100 |
| 50 | 0.19 | 26.30% | 0.73 | 100 |

The results of the first, relative immunogenicity, mouse study were that the exemplary, cell-targeting molecule SLT-1A-combo7::scFv-1 exhibited reduced immunogenicity as compared to the reference, cell-targeted molecule SLT-1A-FR::scFv-1 at all time-points. The average ELISA Absorbance values for the SLT-1A-combo7::scFv-1 treatment group were lower than for the SLT-1A-FR::scFv-1 treatment group at all time-points after Day 1 (sera was collected pre-treatment on Day 1). For the cell-targeting molecules tested, anti-"cell-targeting molecule" IgG responses were first observed on Day 15 (3 days after the administration of the 6th dose), and, then, murine IgG responses were observed at all subsequent time-points: Day 22 (10 days after the administration of the 6th dose, prior to administration of the $7^{th}$ dose), Day 29 (3 days after the administration of the 9th dose prior to administration of the $10^{th}$ dose), Day 36 (3 days after the administration of the last dose), Day 43 (10 days after the administration of the $11^{th}$ dose), and Day 50 (17 days after the administration of the last dose) (FIG. 15-panel A; Table 13). The data in Table 13 showed that the cell-targeting molecule SLT-1A-combo7::scFv-1 comprising the de-immunized, furin-cleavage resistant, Shiga toxin effector polypeptide combo7 had reduced immunogenicity as compared to the cell-targeting molecule SLT-1A-FR::scFv-1 comprising a wild-type Shiga toxin A1 fragment. These results suggest that molecules comprising only Shiga toxin effector polypeptides that consist of the combination, de-immunized, protease cleavage-resistant, Shiga toxin effector polypeptide scaffold combo7 exhibit reduced immunogenicity compared to molecules comprising a Shiga toxin effector polypeptide comprising (1) a wild-type, Shiga-like toxin A1 fragment or (2) the furin-cleavage resistant, Shiga toxin effector polypeptide SLT-1A-FR.

The results of the relative immunogenicity assays from the second mouse study are shown in FIG. 15-panel B and Table 14.

TABLE 14

Relative Immunogenicities of Exemplary, Cell-Targeting Molecules Comprising De-Immunized, Protease-Cleavage Resistant, Shiga Toxin Effector Polypeptides

| Day of serum collection | SLT-1A-combo10::scFv-1 avg signal | SLT-1A-combo10::scFv-1 percent of ref | SLT-1A-combo16::scFv-1 avg signal | SLT-1A-combo16::scFv-1 percent of ref | SLT-1A-combo19::scFv-1 avg signal | SLT-1A-combo19::scFv-1 percent of ref | Reference SLT-1A-FR::scFv-1 avg signal |
|---|---|---|---|---|---|---|---|
| 1 | 0 | N/A | 0 | N/A | 0 | N/A | 0 |
| 15 | 0.36 | 19.2 | 0.26 | 13.5 | 1.21 | 63.7 | 1.9 |
| 22 | 0.44 | 24.3 | 0.44 | 24.4 | 1.29 | 71.2 | 1.81 |
| 29 | 0.27 | 19.5 | 0.71 | 51.5 | 1.21 | 87.2 | 1.38 |
| 36 | 0.59 | 38.4 | 1.10 | 71.2 | 1.46 | 94.6 | 1.55 |
| 40 | 0.83 | 43.3 | 1.38 | 71.5 | 2.06 | 106.8 | 1.93 |

The results of the second, relative immunogenicity, mouse study were that the exemplary, cell-targeting molecules tested (SLT-1A-combo10::scFv-1, SLT-1A-combo16::scFv-1, and SLT-1A-combo19::scFv-1) exhibited reduced immunogenicities as compared to the reference cell-targeted molecule SLT-1A-FR::scFv-1 at all time-points up to Day 36 (FIG. 15-panel B; Table 14). For the cell-targeting molecules tested, anti-"cell-targeting molecule" IgG responses were first observed on Day 15 (3 days after the administration of the 6th dose), and, then, murine IgG responses were observed at all subsequent time-points: Day 22 (10 days after the administration of the $6^{th}$ dose, prior to administration of the $7^{th}$ dose), Day 29 (3 days after the administration of the 9th dose prior to administration of the $10^{th}$ dose), Day 36 (3 days after the administration of the last dose), and Day 40 (7 days after the administration of the last dose) (FIG. 15—panel B; Table 14). At both Day 15 and Day 22, the mice in the group administered the reference cell-targeted molecule SLT-1A-FR::scFv-1 exhibited higher magnitudes of total IgG antibody responses as shown by the ELISA signal than the mice in the groups administered exemplary cell-targeting molecules comprising the de-immunized, protease-cleavage resistant, Shiga toxin effector scaffolds (SLT-1A-combo10, SLT-1A-combo16, and SLT-1A-combo19) (FIG. 15; Table 14). At Days 29, 36, and 40, the percentages of the average reference ELISA signal of the average ELISA signal values for the groups administered SLT-1A-combo16::scFv-1 and SLT-1A-combo19::scFv-1 were higher than for the group administered SLT-1A-combo1::scFv-1. At all time-points, the percentage of the average reference ELISA signal of the average ELISA signal values for the SLT-1A-combo19::scFv-1 group was higher than the percentage of the average ELISA signal values for the group administered SLT-1A-combo10::scFv-1 or SLT-1A-combo16::scFv-1.

The results of the relative immunogenicity assays from the third mouse study are displayed in Table 15 and FIG. 15-panel C.

TABLE 15

Relative Immunogenicities of the Exemplary, Cell-Targeting Molecules Compared to Reference Molecules and Each Other

| Day of serum collection | SLT-1A-combo10::scFv-2 avg ELISA signal | SLT-1A-combo10::scFv-2 percent of ref 1 scFv-3::SLT-1A-WT | SLT-1A-combo10::scFv-2 percent of ref 2 SLT-1A-FR::scFv-2 | reference 1 scFv-3::SLT-1A-WT avg ELISA signal | reference 2 SLT-1A-FR::scFv-2 avg ELISA signal |
|---|---|---|---|---|---|
| 1 | 0 | N/A | N/A | 0 | 0 |
| 15 | 0.11 | 7.4% | 4.9% | 1.49 | 2.25 |
| 22 | 0.27 | 12.3% | 9.6% | 2.20 | 2.81 |
| 29 | 1.28 | 40.6% | 35.2% | 3.15 | 3.64 |

| Day of serum collection | SLT-1A-combo22::scFv-2 avg ELISA signal | SLT-1A-combo22::scFv-2 percent of ref 1 scFv-3::SLT-1A | SLT-1A-combo22::scFv-2 percent of ref 2 SLT-1A-FR::scFv-2 | reference 1 avg ELISA signal | reference 2 avg ELISA signal |
|---|---|---|---|---|---|
| 1 | 0 | N/A | N/A | 0 | 0 |
| 15 | 0.60 | 40.3% | 26.7% | 1.49 | 2.25 |
| 22 | 1.13 | 51.4% | 40.2% | 2.20 | 2.81 |
| 29 | 2.73 | 86.7% | 75.0% | 3.15 | 3.64 |

| Day of serum collection | SLT-1A-combo10::scFv-2 avg ELISA signal | SLT-1A-combo10::scFv-2 percent of ref 3 SLT-1A-combo22::scFv-2 | reference 3 SLT-1A-combo22::scFv-2 avg ELISA signal |
|---|---|---|---|
| 1 | 0 | N/A | 0 |
| 15 | 0.11 | 18.3% | 0.60 |
| 22 | 0.27 | 23.9% | 1.13 |
| 29 | 1.28 | 46.9% | 2.73 |

The average ELISA Absorbance values for the SLT-1A-combo10::scFv-2 and SLT-1A-combo22::scFv-2 treatment groups were lower than for the SLT-1A-FR::scFv-2 and scFv-3::SLT-1A-WT treatment groups at all time-points after Day 1 up to Day 29. The data in Table 15 showed that the cell-targeting molecules SLT-1A-combo10::scFv-2 and SLT-1A-combo22::scFv-2, each comprising a de-immunized, furin-cleavage resistant, Shiga toxin effector polypeptide, exhibited reduced immunogenicities compared to the cell-targeting molecule SLT-1A-FR::scFv2 and the wildtype SLT-1 A1 fragment in the context of a different scFv (scFv-3) in the reverse, carboxy-amino fusion orientation. These results suggest that cell-targeting molecules whose Shiga toxin effector polypeptide region consists of the combination, de-immunized, protease cleavage-resistant, Shiga toxin effector polypeptide scaffold combo10 or combo22 show reduced immunogenicities compared to cell-targeting molecules whose Shiga toxin effector polypeptide region consists of (1) a wild-type, Shiga toxin effector polypeptide or (2) the furin-cleavage resistant, Shiga toxin effector polypeptide SLT-1A-FR.

The results of the relative immunogenicity assays from the fourth mouse study are shown in FIG. 16 and Table 16.

TABLE 16

Relative Immunogenicities of Exemplary, Cell-Targeting Molecules as Compared to SLT-1A-FR::scFv-1

| Day of serum collection | SLT-1A-combo1::scFv-1 avg signal | SLT-1A-combo1::scFv-1 percent of ref 1 | SLT-1A-combo10::scFv-1 avg signal | SLT-1A-combo10::scFv-1 percent of ref 1 | SLT-1A-combo12::scFv-1 avg signal | SLT-1A-combo12::scFv-1 percent of ref 1 | SLT-1A-combo15::scFv-1 avg signal | SLT-1A-combo15::scFv-1 percent of ref 1 | Reference 1 SLT-1A-FR::scFv-1 avg signal |
|---|---|---|---|---|---|---|---|---|---|
| 1 | 0 | N/A | 0 | N/A | 0 | N/A | 0 | N/A | 0 |
| 15 | 0.136 | 41.14 | 0.004 | 1.17 | 0.020 | 6.09 | 0.009 | 2.88 | 0.329 |
| 22 | 0.442 | 61.54 | 0.023 | 3.24 | 0.063 | 8.71 | 0.053 | 7.43 | 0.719 |
| 29 | 0.937 | 47.81 | 0.065 | 3.33 | 0.547 | 27.89 | 0.215 | 10.98 | 1.959 |
| 36 | 1.949 | 94.08 | 0.551 | 26.60 | 1.117 | 53.90 | 0.551 | 26.59 | 2.072 |
| 40 | 2.247 | 99.19 | 0.873 | 38.55 | 1.576 | 69.57 | 0.832 | 36.75 | 2.265 |

| Day of serum collection | SLT-1A-combo10::scFv-1 avg ELISA signal | SLT-1A-combo10::scFv-1 percent of ref 2 SLT-1A-combo1::scFv-1 | Reference 2 SLT-1A-combo1::scFv-1 avg ELISA signal |
|---|---|---|---|
| 1 | 0 | N/A | 0 |
| 15 | 0.004 | 2.85% | 0.136 |
| 22 | 0.023 | 5.27% | 0.442 |
| 29 | 0.065 | 6.97% | 0.937 |
| 36 | 0.551 | 28.27% | 1.949 |
| 40 | 0.873 | 38.87% | 2.247 |

The results of the fourth immunogenicity study were that the exemplary, cell-targeting molecules tested exhibited reduced immunogenicities as compared to the reference cell-targeting molecule SLT-1A-FR::scFv-1, at least at earlier time-points (FIG. 14-panel A; Table 16). Sera was collected pre-treatment on Day 1. For the cell-targeting molecules tested, anti-"cell-targeting molecule" IgG responses were first observed on Day 15 (3 days after the administration of the 6th dose), and, then, murine IgG responses were observed at all subsequent time-points: Day 22 (10 days after the administration of the 6th dose, prior to administration of the $7^1$ dose), Day 29 (3 days after the administration of the 9th dose prior to administration of the $10^{th}$ dose), Day 36 (3 days after the administration of the last dose), and Day 40 (7 days after the administration of the last dose) (FIG. 14; Table 16). At both Day 15, Day 22 and Day 29, the mice in the group administered the reference cell-targeting molecule SLT-1A-FR::scFv-1 exhibited higher magnitudes of total IgG antibody responses as shown by the ELISA signal than the mice in the groups administered exemplary cell-targeting molecules comprising the de-immunized, protease-cleavage resistant, Shiga toxin effector scaffolds (SLT-1A-combo1, SLT-1A-combo10, SLT-1A-combo12, and SLT-1A-combo15) (FIG. 16; Table 16). At all time-points, the percentage of the average reference ELISA signal of the average ELISA signal values for the SLT-1A-combo1::scFv-1 treatment group was higher than the percentage of the average ELISA signal values for the treatment groups administered SLT-1A-combo10::scFv-1, SLT-1A-combo12::scFv-1, and SLT-1A-combo15::scFv-1. At Days 36 and 40, the percentages of the average reference ELISA signal of the average ELISA signal values for the treatment group administered SLT-1A-combo12::scFv-1 were higher than for the treatment group administered SLT-1A-combo10::scFv-1 and SLT-1A-combo15::scFv-1. These results suggest that cell-targeting molecules whose Shiga toxin effector polypeptide region consists of the combination, de-immunized, protease cleavage-resistant, Shiga toxin effector polypeptide scaffold SLT-1A-combo1, SLT-1A-combo10, SLT-1A-combo12, and SLT-1A-combo15 show reduced immunogenicity compared to cell-targeting molecules whose Shiga toxin effector polypeptide region consists of (1) a wild-type, Shiga toxin effector polypeptide or (2) the furin-cleavage resistant, Shiga toxin effector polypeptide SLT-1A-FR.

Of the cell-targeting molecules tested in the second, third, and fourth mouse studies, the combination, de-immunized, protease-cleavage resistant, Shiga toxin effector scaffold SLT-1A-combo10 appeared to be the most de-immunized by this relative immunogenicity assay under the conditions tested (see FIGS. 15-16; Tables 14-16). This Shiga toxin effector scaffold comprised (1) five, disrupted epitope regions, two of which involved multiple amino acid residue substitutions, and (2) an endogenous epitope region disrupted by an embedded, heterologous, T-cell epitope. In the second study, the combination, de-immunized, protease-cleavage resistant, Shiga toxin effector scaffold SLT-1A-combo16 appeared to be more de-immunized than the combination, de-immunized, protease-cleavage resistant, Shiga toxin effector scaffold SLT-1A-combo19, especially at earlier time-points (see FIG. 15-panel B; Table 14). In the fourth study, the combination, de-immunized, protease-cleavage resistant, Shiga toxin effector scaffold SLT-1A-combo1 appeared to be the least de-immunized of the tested, Shiga toxin effector polypeptides SLT-1A-combos (1, 10, 12 and 15) (see FIG. 16-panel A; Table 16). In the fourth study, the combination, de-immunized, protease-cleavage resistant, Shiga toxin effector scaffold SLT-1A-combo15 appeared to be more de-immunized than SLT-1A-combo12, especially at later time-points (see FIG. 16-panel A; Table 16).

The results of these immunogenicity studies indicate that two types of epitope region disruptions, amino acid residue substitutions and embedded, heterologous, CD8+ T-cell epitopes, can contribute to the de-immunization of a Shiga toxin effector polypeptide. Further, the combination of both types of disruptions in the same Shiga toxin effector polypeptide can result in a more de-immunized, Shiga toxin effector polypeptide. The overall magnitude of antibody induction in the mice in the groups administered exemplary, cytotoxic, cell-targeting molecules comprising these combination, de-immunized, CD8+ T-cell hyper-immunized, protease-cleavage resistant, Shiga toxin effector polypeptides was reduced as compared to magnitude of antibody induction in the mice in the group administered the cell-targeting molecule comprising the protease-cleavage resistant but otherwise wild-type Shiga toxin effector polypeptide region. The decreases in the ELISA signal values of the cell-targeting molecules comprising certain, combination, de-immunized, protease-cleavage resistant, Shiga toxin effector scaffolds demonstrates that these particular scaffolds were successfully de-immunized (i.e. had reduced immunogenic potential in mammals). Thus, the Shiga toxin effector polypeptides SLT-1A-combo1, SLT-1A-combo7, SLT-1A-combo10, SLT-1A-combo12, SLT-1A-combo15, SLT-1A-combo16, and SLT-1A-combo19 exhibited reduced immunogenic potential in mammals, and any, exemplary, cell-targeting molecule comprising these polypeptides should be de-immunized as compared to an analogous molecule comprising only wild-type or merely protease-cleavage resistant, Shiga toxin effector polypeptides due to furin-cleavage motif mutations in the natively positioned region from amino acid residues 238 to 257 in StxA and SLT-1A.

Differences observed in the immunogenic potentials of the different combination, de-immunized, protease-cleavage resistant, Shiga toxin effector polypeptides tested shows that certain combinations of de-immunized sub-regions and/or embedded T-cell epitope sub-regions reduce immunogenicity by different magnitudes. For example in study 2, SLT-1A-combo10 was more de-immunized than SLT-1A-combo16 and SLT-1A-combo 19, especially at later time-points (Table 14; FIG. 15-panel B), despite combo16 and combo19 comprising more disrupted epitope regions and total amino acid residue substitutions compared to a wild-type Shiga toxin A Subunit than SLT-1A-combo10 comprises (Table 8). In study 4, SLT-1A-combo10 was more de-immunized than SLT-1A-combo12, especially at later time-points (Table 16; FIG. 16-panel A) despite that both SLT-1A-combo12 and SLT-1A-combo15 comprise more disrupted epitope regions and total amino acid residue substitutions compared to a wild-type Shiga toxin A Subunit than SLT-1A-combo10 comprises (Table 8). Thus, the cumulative combination of additional B-cell epitope region disruptions did not necessarily result in additional decreases in immunogenicity but rather may result in increases in unwanted immunogenicities, such as, e.g., at later time-points (see FIG. 15-panel B and compare the results for SLT-1A-combo10 with the results for SLT-1A-combo16 and SLT-1A-combo19).

I. Testing the Ability of Exemplary, Cell-Targeting Molecules to Deliver a T-Cell Epitope-Peptide to the MHC Class I Pathway of a Cell for Presentation The presentation of a T-cell epitope by the MHC class I system targets the presenting cell for killing by CTL-mediated lysis and also triggers immune stimulation in the local area. By engineering cell-targeting molecules comprising Shiga toxin effector polypeptides comprising heterologous, immunogenic epitopes, the targeted delivery and presentation of immuno-stimulatory antigens may be accomplished. The presentation of immuno-stimulatory non-self antigens, such as e.g. known viral antigens with high immunogenicity, by target cells signals to other immune cells to destroy the target cells as well as to recruit more immune cells to that area within an organism.

In order to simultaneously de-immunize and provide for T-cell epitope presentation on the target cell surface within the same Shiga toxin effector polypeptide region, a predicted B-cell epitope region was disrupted by replacing amino acid residues within it with an immunogenic T-cell epitope region predicted to bind to human MHC class I molecules.

In this Example, the abilities of exemplary cell-targeting molecules of the present invention to deliver T-cell epitopes to the MHC class I pathway of target cells for presentation to the target cell surface are investigated. In addition, the functional consequences of target cells' MHC class I presentation of T-cell epitopes delivered by exemplary cell-targeting molecules of the present invention are investigated by observing various immune responses induced by the presentation of the delivered epitope-peptide by an MHC I molecule. 1. Testing the Ability of a Molecule to Deliver a T-Cell Epitope-Peptide to the MHC Class I Pathway for Presentation on the Cell Surface Routine assays known in the art are used to investigate the ability of exemplary molecules of the present invention to deliver a T-cell epitope to a MHC class I molecule (see e.g. WO 2015/113007). In particular, a flow cytometry method is used to demonstrate delivery and extracellular display of a T-cell epitope-peptide (inserted or embedded in a Shiga toxin effector polypeptide) in complex with MHC class I molecules on the surfaces of target cells. This flow cytometry method utilizes soluble human T-cell receptor (TCR) multimer reagents (Soluble T-Cell Antigen Receptor STAR™ Multimer, Altor Bioscience Corp., Miramar, Fla., U.S.), each with high-affinity binding to a different epitope-human HLA complex.

Each STAR™ TCR multimer reagent is derived from a specific T-cell receptor and allows detection of a specific peptide-MHC complex based on the ability of the chosen TCR to recognize a specific peptide presented in the context of a particular MHC class I molecule. These TCR multimers are composed of recombinant human TCRs which have been biotinylated and multimerized with streptavidin. The TCR multimers are labeled with phycoerythrin (PE). These TCR multimer reagents allow the detection of specific peptide-MHC class I complexes presented on the surfaces of human cells because each soluble TCR multimer type recognizes and stably binds to a specific peptide-MHC complex under varied conditions (Zhu X et al., *J Immunol* 176: 3223-32 (2006)). These TCR multimer reagents allow the identification and quantitation by flow cytometry of peptide-MHC class I complexes present on the surfaces of cells.

The target cells used in this Example are available from the ATCC (Manassas Va., U.S.), National Cancer Institute of the U.S. (Frederick, Md., U.S.), and/or DSZM (Braunschweig, Del.). Using standard flow cytometry methods known in the art, the target cells are confirmed to express on their cell surfaces both the appropriate MHC-class I molecule and the extracellular target biomolecule of the cell-targeting moiety of the cell-targeting molecules used in this Example.

The target cells are treated with exemplary cell-targeting molecules of the present invention that each comprise a Shiga toxin effector polypeptide comprising an embedded or inserted T-cell epitope. Certain exemplary molecules of the present invention tested in this Example are catalytically impaired or inactivated by the addition of one or both of the following mutations: Y77S and E167D. Sets of target cells are treated by exogenous administration of the different exemplary cell-targeting molecules of the invention at concentrations similar to those used by others taking into account cell-type specific sensitivities to Shiga toxins (see e.g. Noakes K et al., *FEBS Lett* 453: 95-9 (1999)). The treated cells are then incubated for six hours in standard conditions, including at 37° C. and an atmosphere with 5% carbon dioxide, to allow for intoxication mediated by a Shiga toxin effector polypeptide region. Then the cells are washed with cell culture medium, re-suspended in fresh cell culture medium, and incubated for 20 hours prior to staining with the appropriate STAR™ multimer reagent. Additional time-points and setup conditions are also tested.

As controls, sets of target cells are treated in three conditions: 1) without any treatment ("untreated") meaning that no exogenous molecules are added, 2) with exogenously administered control antigen-peptide, and 3) with exogenously administered control antigen-peptide combined with a Peptide Loading Enhancer ("PLE," Altor Bioscience Corp., Miramar, Fla., U.S.). The control antigen-peptide peptide combined with PLE treatment allowed for exogenous peptide loading and served as a positive control. Cells displaying the appropriate MHC class I haplotype can be forced to load the appropriate exogenously applied peptide from an extracellular space (i.e. in the absence of cellular internalization of the applied peptide) or in the presence of PLE, which is a mixture of B2-microglobulin and other components.

After the treatments, all the sets of cells are washed and incubated with the appropriate STAR multimer reagent for one hour on ice. The cells are washed and the fluorescence of the samples are measured by flow cytometry using an Accuri™ C6 flow cytometer (BD Biosciences, San Jose, Calif., U.S.) to detect the presence of and quantify any STAR™ multimer bound to cells in the population (sometimes referred to herein as "staining").

The untreated control is used to identify the positive and negative cell populations by employing a gate which results in less than 1% of cells from the untreated control in the "positive" gate (representing background signal). The same gate is then applied to the other samples to characterize the positive population for each sample.

The detection of the exogenously administered, embedded or inserted T-cell epitope complexed with human MHC class I molecules on the cell surface of intoxicated target cells demonstrates that cell-targeting molecules comprising the embedded or inserted T-cell epitope-peptide are capable of entering target cells, performing sufficient sub-cellular routing, and delivering enough T-cell epitope to the MHC class I pathway for surface presentation on the target cell surface. 2. Testing the Ability of a Molecule to Induce Cytotoxic T-Cell Mediated Cytolysis of Target Cells and Other Immune Responses Routine assays known in the art are used to investigate the functional consequences of target cells' MHC class I presentation of T-cell epitopes delivered by exemplary cell-targeting molecules of the invention (see e.g. WO 2015/113007). The functional consequences to investigate include CTL activation, CTL-mediated target-cell-killing, and cytokine release by CTLs.

A CTL-based cytotoxicity assay is used to assess the consequences of epitope presentation. The assay involves tissue-cultured target cells and T-cells. Target cells are intoxicated as described in WO 2015/113007. Briefly, target cells are incubated for six hours in standard conditions with different exogenously administered, cell-targeting molecules, where certain cell-targeting molecules comprise a Shiga toxin effector polypeptide of the invention. Next, CTLs are added to the intoxicated target cells and incubated to allow for the T-cells to recognize and bind any target-cells displaying epitope-peptide/MHC class I complexes. Then certain functional consequences are investigated using standard methods known to the skilled worker, including CTL binding to target cells, target-cell-killing by CTL-mediated cytolysis, and the release of cytokines, such as interferon gamma or interleukins by ELISA or ELIspot.

The activation of CTLs by target cells displaying epitope-peptide/MHC class I complexes is quantified using commercially available CTL response assays, e.g. CytoTox96® non-radioactive assays (Promega Corp., Madison, Wis., U.S.), Granzyme B ELISpot assays (Mabtech, Inc., Cincinnati, Ohio, U.S.), caspase activity 10 assays, and LAMP-1 translocation flow cytometric assays. To specifically monitor CTL-mediated killing of target cells, carboxyfluorescein succinimidyl ester (CFSE) is used to target-cells for in vitro and in vivo investigation as described in the art (see e.g. Durward M et al., *J Vis Exp* 45 pii 2250 (2010)).

Summary of Example 2

Exemplary, cell-targeting molecules comprising combination, Shiga toxin effector polypeptide with multiple B-cell epitope region disruptions were de-immunized as shown by reductions in both antigenicity and immunogenicity as compared to reference molecules. In addition, this Example shows that certain, de-immunized cell-targeting molecules comprising combination, Shiga toxin effector polypeptides comprising multiple B-cell epitope region disruptions, furin cleavage motif disruptions, and/or embedded T-cell epitopes retain at a significant level of one or more Shiga toxin effector functions, such as, e.g., catalytic ribosome inhibition, intracellular routing, and cytotoxicity.

Table 17 summarizes results from Example 2 for the exemplary, protease-cleavage resistant, de-immunized, cell-targeting molecules of the present invention which comprise the Shiga toxin effector polypeptide SLT-1A-combo1, SLT-1A-combo7, SLT-1A-combo10, SLT-1A-combo12, SLT-1A-combo15, SLT-1A-combo16, or SLT-1A-combo19.

TABLE 17

Summary of Exemplary Cell-Targeting Molecules Empirically Tested for Cytotoxicity and Reduced Immunogenic Potential in Mammals

| cell-targeting molecule scaffold | Cytotoxicity ($CD_{50}$ in nM) Varies with the cell-line | Immunogenicity compared to SLT-1A-FR:scFv-1 |
|---|---|---|
| SLT-1A-combo1::scFv-1 | 0.02 | 41-99% |
| SLT-1A-combo7::scFv-1 | 0.01, 0.02, 0.03, 0.12, 0.13, 0.39 | 4-36% |
| SLT-1A-combo10::scFv-1 | 0.03, 0.07, 0.08, 0.25, 0.84 | 1-43% |
| SLT-1A-combo12::scFv-1 | 0.07, 0.18 | 6-70% |
| SLT-1A-combo15::scFv-1 | 0.05, 0.09 | 3-37% |

TABLE 17-continued

| Summary of Exemplary Cell-Targeting Molecules Empirically Tested for Cytotoxicity and Reduced Immunogenic Potential in Mammals | | |
|---|---|---|
| cell-targeting molecule scaffold | Cytotoxicity ($CD_{50}$ in nM) Varies with the cell-line | Immunogenicity compared to SLT-1A-FR:scFv-1 |
| SLT-1A-combo16::scFv-1 | 0.03, 0.12 | 14-72% |
| SLT-1A-combo19::scFv-1 | 0.03, 0.16 | 64-107% |
| SLT-1A-FR::scFv-1 | 0.01, 0.02, 0.05, 0.10, 0.28 | 100% |

The exemplary, protease-cleavage resistant, de-immunized, cell-targeting molecules of the invention shown in Table 17 all exhibited significant levels of cytotoxicity which were comparable to cell-targeting molecules comprising wild-type Shiga toxin A1 fragments. These exemplary, protease-cleavage resistant, de-immunized, cell-targeting molecules of the invention exhibit catalytic inhibition of translation by ribosomes, intracellular routing comparable to wild-type a Shiga toxin A Subunit and/or A1 fragment, and cytotoxicity comparable to a cell-targeting molecules comprising a wild-type Shiga toxin A1 fragment and/or A Subunit. These exemplary, protease-cleavage resistant, de-immunized, cell-targeting molecules of the invention exhibit levels of catalytic activity comparable to a wild-type, Shiga toxin A Subunit and/or A1 fragment. These exemplary, protease-cleavage resistant, de-immunized, cell-targeting molecules of the invention exhibit levels of cytotoxicity comparable to a wild-type Shiga toxin A Subunit and/or A1 fragment. These cell-targeting molecules of the invention all exhibited reduced immunogenicity in mammals as compared to cell-targeting molecules comprising a Shiga toxin effector polypeptide region consisting of (1) a wild-type, Shiga toxin A1 fragment and/or (2) the furin-cleavage resistant, Shiga toxin effector polypeptide SLT-1A-FR. Furthermore, certain cell-targeting molecules of the present invention exhibit increased stability, improved in vivo tolerability, and/or the ability to deliver heterologous, T-cell epitopes for MHC class I presentation by target cells.

The results shown in Example 2 reinforce the idea that various, exemplary, epitope region disruptions may be combined together in a single molecule to create greater reductions in antigenicity and/or immunogenicity while still retaining significant levels of one or more Shiga toxin effector function (see e.g. WO 2015/113005) and sometimes providing another functional feature(s) not present in wild-type Shiga toxin A Subunits, such as, e.g., furin-cleavage resistance and/or the ability to deliver a heterologous, T-cell epitope to a target cell. Certain, combination, de-immunized, Shiga toxin A Subunit effector polypeptides of the present invention exhibit synergistic reductions in immunogenicity as compared to the sum of their partially de-immunized sub-regions, such as, e.g., SLT-1A-combo7 SLT-1A-combo10, and SLT-1A-combo15.

The following substitutions have been made and tested in at least one Shiga toxin effector polypeptide which retained a significant level of in vitro, ribosome inhibition and/or cytotoxicity: K1A, K1M, T4I, S8I, T9I, K11A, S33I, S33C, S43N, G44L, S45V, T45V, S45I, T45I, G46P, D47M, N48V, L49A, F50T, A51V, D53A, D53N, V54L, V54I, R55A, R55V, R55L, G56P, I57F, I57M, D58A, D58V, D58F, P59A, P59F, E60, E60T, E60R, E61A, E61V, E61L, G62A, D94A, S96I, T104N, A105L, T107P, L108M, S109V, G110A, D111T, D141A, V154A, G147A, T180G, T181, D183A, D183G, D184A, D184A, D184F, L185D, S186A, S186F, G187A, G187T, R188A, S189A, D198A, R205A, C242S, R248A, and R251A.

Despite the challenges predicting successful substitutions apriori, the data provided in the Examples herein give reasons to believe that certain amino acid substitutions are likely to successfully reduce antigenicity and/or immunogenicity while maintaining significant Shiga toxin effector function(s). The term "successful" is used here to mean one or more amino acid residue substitutions in a predicted epitope region resulted in a Shiga toxin effector polypeptide which retained one or more Shiga toxin effector functions. For example, substitutions at specific amino acid positions shown herein as successfully tolerating substitutions are likely to be successful for retaining at least one Shiga toxin effector function when substituted with certain other amino acids. Successful single amino acid substitution may generally be combined with other successful amino acid substitutions in a different epitope region to generate de-immunized, Shiga toxin effector polypeptides which retain significant Shiga toxin effector function(s). Similarly, the demonstration that cell-targeting molecules comprising Shiga toxin effector polypeptide regions with multiple single amino acid substitutions within the same epitope region retained enzymatic activity suggests that successful single amino acid substitution in the same epitope region may generally be combined with other single amino acid substitutions in the same epitope region to generate de-immunized, Shiga toxin effector polypeptides which retain significant Shiga toxin effector function(s).

It has been empirically demonstrated that certain substitutions (K1A, K1M, T4I, S8I, T9I, K11A, S33I, S33C, S43N, G44L, S45V, T45V, S45I, T45I, G46P, D47M, N48V, L49A, F50T, A51V, D53A, D53N, V54L, V54I, R55A, R55V, R55L, G56P, I57F, I57M, D58A, D58V, D58F, P59A, P59F, E60I, E60T, E60R, E61A, E61V, E61L, G62A, D94A, S96I, T104N, A105L, T107P, L108M, S109V, G110A, D111T, D141A, G147A, V154A, G147A, T180G, T181I, D183A, D183G, D184A, D184A, D184F, L185D, S186A, S186F, G187A, G187T, R188A, S189A, D198A, R205A, C242S, R248A, R251A, and/or combinations thereof) and certain positions tolerated substitutions (1, 4, 8, 9, 11, 33, 43, 44, 45, 46, 47, 48, 49, 50, 51, 53, 54, 55, 56, 57, 58, 59, 60, 61, 62, 94, 96, 104, 105, 107, 108, 109, 110, 111, 141, 147, 154, 180, 181, 183, 184, 185, 186, 187, 188, 189, 198, 205, 242, 248, and 251) while retaining a significant level of activity for at least one Shiga toxin effector function. This empirical data suggest certain other epitope disrupting substitutions and combinations of epitope disrupting substitutions which may be used to generate de-immunized, Shiga toxin effector polypeptides which retain significant Shiga toxin effector function(s). It is predictable that other amino acid substitutions to amino acid residues of a conservative functional group will also be tolerated. For example, other substitutions known to the skilled worker to be similar to any of K1A, K1M, T4I, S8I, T9I, K11A, S33I, S33C, S43N, G44L, S45V, T45V, S45I, T45I, G46P, D47M, N48V, L49A, F50T, A51V, D53A, D53N, V54L, V54I, R55A, R55V, R55L, G56P, I57F, I57M, D58A, D58V, D58F, P59A, P59F, E60, E60T, E60R, E61A, E61V, E61L, G62A, D94A, S96I, T104N, A105L, T107P, L108M, S109V, G110A, D111T, D141A, G147A, V154A, G147A, T180G, T181I, D183A, D183G, D184A, D184A, D184F, L185D, S186A, S186F, G187A, G187T, R188A, S189A, D198A, R205A, C242S, R248A, or R251A will also be able to disrupt an epitope while maintaining at least one Shiga toxin effector function.

Example 3. Furin-Cleavage Resistant, Shiga Toxin A Subunit Effector Polypeptides and Cell-Targeting Molecules Comprising the Same Furin-cleavage resistant, Shiga toxin A Subunit effector polypeptides were created and tested as components of cell-targeting molecules wherein each cell-targeting molecule comprised a cell-targeting, immunoglobulin-type, binding region. To engineer protease resistance into a Shiga toxin effector polypeptide, two amino acid residue substitutions, R248A and R251A, were introduced into Shiga toxin effector polypeptides as described in Example 2. The Shiga toxin effector polypeptide SLT-1A-FR (SEQ ID NO:5) was used to create the cell-targeting molecule SLT-1A-FR::scFv-9 (SEQ ID NO:41).

A. Quantifying Furin Cleavage of a Molecule of the Present Invention Relative to a Reference Molecule The cell-targeting molecule SLT-1A-FR::scFv-9 (SEQ ID NO:41) was tested using an in vitro, furin-cleavage assay to quantify furin cleavage as compared to a wild-type control using methods known to the skilled worker (see e.g. WO 2015/191764). To assess the ability of furin to cleave SLT-1A-FR::scFv-9, purified protein samples in phosphate buffered saline (PBS) were incubated with furin (New England Biolabs, Ipswich, Mass., U.S.) at 0.5 furin activity units (U) per microgram (μg) of sample protein in furin cleavage buffer (100 millimolar (mM) HEPES (4-(2-hydroxyethyl)-1-piperazineethanesulfonic acid), pH 7, 1 mM $CaCl_2$) for 30 hours at 30° C. Control samples were incubated without furin at 4° C. or 30° C. in the same buffer. The various, cell-targeting molecule samples were electrophoresed on SDS, polyacrylamide gels under denaturing conditions and stained with Coomassie (FIG. 17).

FIG. 17 shows a picture of a gel with the lanes numbered and a figure legend indicating which lane was loaded with which sample: either a cell-targeting molecule comprising a wild-type Shiga toxin effector polypeptide region (SLT-1A-WT) or a furin-cleavage site disrupted, Shiga toxin effector polypeptide (SLT-1A-FR). The lanes marked "MW Marker" show the migration pattern of a protein molecular weight ladder along with the approximate size of individual ladder protein bands in kiloDaltons (kDa) for use as an internal molecular weight reference that allows for the estimation of the sizes of proteins in the numbered lanes. The figure legend indicates the pre-treatment conditions of the cell-targeting molecule samples with the temperature in degrees Celsius (° C.), duration, and whether any furin was added by denoting the amount of furin activity units per microgram (labeled "U/μg furin") or "no furin" for zero units.

FIG. 17 shows that SLT-1A-FR::scFv-9 (SEQ ID NO:41) was resistant to proteolytic cleavage by human furin. The cell-targeting molecules tested in this assay were both about 56 kDa in size and comprised a Shiga toxin effector polypeptide of about 28 kDa (identical in size for both SLT-1A-WT or SLT-1A-FR) linked to a carboxy-terminal linker and binding region which together were about 28 kDa in size. If furin cleavage had occurred in the surface exposed, extended loop 242-251 of SLT-1A, then the expected result would be two protein bands with near equal molecular weights of around 28 kDa each. If furin cleavage occurs precisely at the carboxy peptide bond of the arginine at position 251 of the WT scaffold in SLT-1A-WT::scFv-9, then the two resulting protein bands should have the molecular weights of 27.5 kDa for SLT-1A (either WT or FR) and of 28.3 kDa for scFv-9.

The gel was analyzed using GelAnalyzer 2010 software. This software detected the lanes of the gel pictured in FIG. 17 and the bands within each lane. Using background subtraction mode, the background was automatically defined and subtracted from the volumes of all bands analyzed using a rolling ball background subtraction with the ball radius set at 25. The results of this quantitative band analysis of the gel pictured in FIG. 17 is summarized in Table 18. Table 18 shows the relative mobility and raw volume values for certain bands migrating around 56 kDa in lanes 1-6 in the gel pictured in FIG. 17. The "no furin" 4° C. treatment of the cell-targeted molecule (SLT-1A-WT::scFv-9) (SEQ ID NO:42), which comprises a wild-type Shiga toxin effector polypeptide, results in lane #2 was used as a control to determine the percentage of uncleaved material at 30° C. in the absence or presence of furin (lanes #2 and #3, respectively). For the SLT-1A-FR::scFv-9 samples, the "no furin" 4° C. lane (lane #4) was used to determine the percentage of uncleaved material at 30° C. in the absence or presence of furin (lanes #5 and #6, respectively). For each molecule, the "percentage uncleaved" of the 56 kDa band for each furin treated sample was calculated by the following formula: (Raw Volume of ~56 kDa sample band)/(Raw Volume of ~56 kDa band from the "no furin" 4° C. treatment)×100 (see Table 18).

TABLE 18

Quantification of Furin-Cleavage Relative to a Reference Molecule

| Treatment | Lane # | Relative mobility ($R_f$) of~ 56 kDa Band | Raw Volume | Percentage uncleaved |
|---|---|---|---|---|
| SLT-1A-WT::scFv-9 | | | | |
| no furin, 4° C. | 1 | 0.39 | 753 | 100.0% |
| no furin, 30° C. | 2 | 0.36 | 766 | 101.7% |
| 0.5 U/μg furin, 30° C. | 3 | 0.34 | 246 | 32.7% |
| SLT-1A-FR::scFv-9 | | | | |
| no furin, 4° C. | 4 | 0.37 | 995 | 100.0% |
| no furin, 30° C. | 5 | 0.39 | 985 | 99.0% |
| 0.5 U/μg furin, 30° C. | 6 | 0.37 | 1000 | 100.5 |

For the wild-type furin site samples, the amount of protein in the 56 kDa band for the sample incubated with furin was reduced compared to the amount of protein in the 56 kDa band for "no furin" samples (Table 18; FIG. 17, lane #3 compared to lanes #1 and #2). The furin treatment of SLT-1A-WT::scFv-9 resulted in the production of two new bands of about 28 kDa (FIG. 17, lane #3), which match the expected sizes of furin-cleavage products resulting from cleavage at the carboxy-terminus of the Shia toxin A1 fragment region of SLT-1A-WT::scFv-9. For the SLT-1A-

FR::scFv-9 samples, the amount of protein in the 55 kDa band in the sample incubated with furin lane appeared unchanged from the amount of protein in the 55 kDa band for "no furin" samples (Table 18; FIG. 17, lane #6 compared to lanes #4 and #5).

This quantitative analysis showed that a cell-targeting molecule designed with the wild-type Shiga toxin effector polypeptide SLT-1A-WT and a carboxy-terminal binding region exhibited about 67.3% cleavage with about 32.7% of SLT-1A-WT::scFv-9 remaining uncleaved. The percentage of furin-cleavage as compared to a reference molecule can be expressed as a ratio of [(available material−uncleaved)/available material] of the molecule of interest to [(available material−uncleaved)/available material] of the reference molecule. In this assay, SLT-1A-FR::scFv-9 exhibited [(985−1000)/1000]/[(766−246)/766]=−1.5% cleavage of the reference or approximately zero cleavage.

This assay showed that a cell-targeting molecule designed with the Shiga toxin effector polypeptide SLT-1A-FR exhibited 0% cleavage with 100% of the cell-targeting molecule remaining uncleaved. Thus, the SLT-1A-FR scaffold appears to be resistant to furin cleavage in this assay under the conditions tested.

B. Testing the In Vivo Tolerability of Cell-Targeting Molecules of the Present Invention Using Laboratory Animals The in vivo tolerability of exemplary, cell-targeting molecules of the present invention is tested using mice in order to determine the degree to which overt adverse effects were detected at various dosages of cell-targeting molecule samples. The tolerability studies are performed using methods known to the skilled worker and/or described herein (see e.g. WO 2015/191764). For example, mice are injected with cell-targeting molecule samples or vehicle controls at doses ranging from 0.25 to 5.00 milligrams per kilogram of body weight per injection (mg/kg/inj) for three times a week over several weeks. In order to assess in vivo tolerability, the injected mice are monitored for changes in health and clinical signs, such as, e.g., aspects of morbidity, morbundity, body weight, physical appearance, measureable clinical signs, unprovoked behavior, and responses to external stimuli, such as, (see e.g. Morton D, Griffiths P, VetRec 116: 431-43 (1985); Montgomery C, *Cancer Bull* 42: 230-7 (1990); Ullman-Culleré M, Foltz C, *Lab Anim Sc* 49: 319-23 (1999); Clingerman K, *Summers L, JAm Assoc Lab Anim Sci* 51: 31-6 (2012)). Euthanasia may be used in response to signs of morbidity and/or morbundity and, thus, create a mortality time-point. For example, a decrease in body weight of 15-20% in 2-3 days can be used as a sign of morbidity in rodents and as a justification for euthanization (see e.g. Institute of Laboratory Animal Research 2011. *Guide for the care and use of laboratory animals,* 8th ed., Washington, D.C., U.S.: National Academies Press).

The cell-targeting molecules of the present invention that comprise furin-cleavage resistant, Shiga toxin effector polypeptides exhibit improved tolerability (e.g. improved non-specific toxicity profiles) as compared to related, reference molecules comprising wild-type Shiga toxin A1 fragments (see e.g. WO 2015/191764). Such improved in vivo tolerability may be due to the increased stability of a linkage between a Shiga toxin effector polypeptide and a binding region and/or toxic component of the cell-targeting molecule.

C. Testing the Targeted Cytotoxicity and Efficacy of Exemplary, Cell-Targeting Molecules of the Present Invention In Vivo Using Animal Models Animal models are used to determine the in vivo effects of exemplary, Shiga toxin effector polypeptides combo(n) and cell-targeting molecules comprising the aforementioned to target positive, neoplastic cells. Various mice strains are used to test the effects of the cell-targeting molecules on xenograft tumors in mice after intravenous administration of each molecule to those mice. In certain experiments, a disseminated xenograft model for human tumors is used to determine the in vivo efficacy of exemplary, cell-targeting molecules of the present invention in human-tumor bearing mice. Human tumor cells that constitutively express luciferase and display cell-surface expression of the target of the appropriate scFv-(n) are used in this xenograft model. Methods known to the skilled worker are used to test the targeted cytotoxicity of molecules of the present invention (see e.g. WO 2014/164680, WO 2014/164693, WO 2015/191764). Certain cell-targeting molecules of the present invention are capable of significantly reducing the human tumor burden in mice challenged with human tumor cells.

As shown in Examples 1-4, combination Shiga toxin A Subunit effector polypeptides of the present invention may be used as scaffolds to create cell-targeting molecules that exhibit: 1) increased stability, 2) improved in vivo tolerability in chordates, 2) reduced immunogenic potential after administration to chordates, and/or the ability to deliver an embedded or inserted T-cell epitope for MHC class I presentation by a nucleated, chordate cell. In certain combinations, the resulting level of de-immunization represents the synergistic action of individually de-immunized sub-regions which were combined together.

Example 4. An Exemplary Cell-Targeting Molecule Targeting CD38+ Cells

The binding characteristics of the "SLT-1A-combo7::αCD38-scFv-1" protein (SEQ ID NO:82) to an extracellular, human CD38 target was determined by a fluorescence-based, flow-cytometry assay. Samples containing CD38 positive (CD38+) cells (of either the cell line A or F) were suspended in 1×PBS containing one percent bovine serum albumin (BSA) (Calbiochem, San Diego, Calif., U.S.), hereinafter referred to as "1×PBS+1% BSA", and incubated for one hour at 4° C. with 100 μL of various dilutions of SLT-1A-combo7::αCD38-scFv-1. The highest concentrations of SLT-1A-combo7::αCD38-scFv-1 tested in the assay was selected to saturate all of the binding possibilities. CD38 negative (CD38-) cells (of the cell lines H and I) were treated with the highest concentration of SLT-1A-combo7::αCD38-scFv-1 tested on target positive cells in this assay. After the one hour incubation, the cell samples were washed twice with 1×PBS+1% BSA. The cell samples were incubated for one hour at 4° C. with 100 μL of 1×PBS+1% BSA containing α-SLT-1A pAb1, then washed again and incubated for one hour at 4° C. with 100 μL of 1×PBS+1% BSA solution containing an anti-rabbit secondary antibody conjugated to fluorescein isothiocyanate (FITC).

The cell samples were washed twice with 1×PBS+1% BSA, resuspended in 200 μL of 1×PBS and subjected to fluorescence-based, flow cytometry to assay the percentage of cells bound by sufficient secondary antibody, indicative of the binding levels of SLT-1A-combo7::αCD38-scFv-1 to the cells in each sample. The data for all the samples in mean fluorescence intensity units (MFI), in relative fluorescence units, was obtained by gating the data using a negative control sample of cells which was not treated with any cell-targeting molecule but which was incubated with the α-SLT-1A pAb1 primary antibody and the anti-rabbit secondary antibody as described above. The integrated MFI (iMFI) was calculated by multiplying the percentage of positive cells with the MFI. Graphs were plotted of iMFI versus "concentration of protein" in nanomolar using Prism software (GraphPad Software, San Diego, Calif., U.S.). Using the Prism software function of one-site binding [$Y=B_{max}*X/(K_D+X)$] under the heading binding-saturation, the $B_{max}$ and $K_D$ were calculated using baseline corrected data. $B_{max}$ is the maximum specific binding reported in iMFI. $K_D$ is the equilibrium binding constant, reported in nanomolar.

The $B_{max}$ for SLT-1A-combo7::αCD38-scFv-1 (SEQ ID NO:82) binding to two, different, CD38+ cell types was measured to be approximately 100,000 iMFI, and the $K_D$ of SLT-1A-combo7::αCD38-scFv-1 binding those CD38+ cells was measured to be approximately 2-7 nM (Table 19; FIG. 18). SLT-1A-combo7::αCD38-scFv-1 did not exhibit specific binding to CD38− cells or high affinity binding to CD38− cells in this assay under the conditions described (FIG. 18).

TABLE 19

Binding Characteristics: Representative Values for $B_{max}$ and $K_D$ for Cell Binding by an Exemplary, Cell-Targeting Molecule of the Present Invention

| | target positive cell line A | | target positive cell line F | |
|---|---|---|---|---|
| Cell-Targeting Molecule | $B_{max}$ (iMFI) | $K_D$ (nM) | Bmax (iMFI) | $K_D$ (nM) |
| SLT-1A-combo7::αCD38-scFv-1 | 112,660 | 7.1 | 93,966 | 1.6 |

The exemplary, CD38-targeted, cell-targeting molecule SLT-1A-combo7::αCD38-scFv-1 was tested for catalytic activity as described in Example 2. SLT-1A-combo7::αCD38-scFv-1 (SEQ ID NO:82) exhibited ribosome inactivation activity comparable to a wild-type.

The exemplary, CD38-targeted, cell-targeting molecule SLT-1A-combo7::αCD38-scFv-1 was tested for cytotoxicity as described in Example 2. SLT-1A-combo7::αCD38-scFv-1 (SEQ ID NO:82) was potently cytotoxic to CD38+ cells.

The exemplary, CD38-targeted, cell-targeting molecule SLT-1A-combo7::αCD38-scFv-1 was tested for reduced immunogenicity as described in Example 2. SLT-1A-combo7::αCD38-scFv-1 (SEQ ID NO:82) exhibited reduced immunogenicity as compared to a control SLT-1A-FR::αCD38-scFv-1.

The exemplary, CD38-targeted, cell-targeting molecule SLT-1A-combo7::αCD38-scFv-1 was tested in a xenograft model of human cancer using human cells expressing CD38 and an assay known to the skilled worker (see e.g. WO 2014/164693). SLT-1A-combo7::αCD38-scFv-1 (SEQ ID NO:82) exhibited the ability to reduce tumor burden in mice injected with CD38 positive, human, neoplastic cells as compared to a control, vehicle treated group. In this study, mice were injected with $2.5\times10^6$ Daudi-Luc cells (a human, CD38 positive tumor cell line that has been engineered to express the luciferase gene). Four days after tumor injection, mice were randomized into groups of eight mice per group and treatment was started. The mice in the control and cell-targeting molecule treatment groups received vehicle only or cell-targeting molecule, respectively, for twelve doses over five weeks (three times per week for two weeks, a week of no dosing then three times a week again for 2 weeks). On different days of the study, whole body bioluminescence (BLI) was measured in photons per second to monitor the tumor burden over time by detecting luciferase expressing Daudi cells. Before treatment, the mice were randomized using their BLI readings in order to create mice groups with similar mean and median BLI values. The results of this study are reported in Table 20 and FIG. 19. Table 20 lists the median BLI signal for the cell-targeting molecule treated group and the vehicle-only control group and the percent of "treated over control" (% T/C), defined by the formula: (median BLI signal of the treated group)/(median BLI signal of the vehicle-only control group)×100. Day 4 involved re-treatment measurements.

TABLE 20

Treatment with the Exemplary, Cell-Targeting Molecule SLT-1A-combo7::αCD38-scFv-1 Reduced Tumor Burdens In Vivo

| | Treatment Group | | SLT-1A-combo7:: |
|---|---|---|---|
| Day of Study | cell-targeting molecule | vehicle-only | αCD38-scFv-1 BLI Percentage of the cell-targeting molecule treated over control treated (% T/C) |
| | median BLI signal (photons/second) | | |
| 4 | 1.37e6 | 1.46e6 | 94% |
| 7 | 1.64e6 | 2.10e6 | 78% |
| 14 | 7.66e6 | 9.36e7 | 8% |
| 22 | 3.60e8 | 4.22e9 | 9% |
| 28 | 1.88e9 | 9.32e9 | 20% |
| 35 | 1.24e10 | 3.26e10 | 38% |
| 40 | 1.65e10 | 1.55e11 | 11% |

BLI measurements taken on study Days 7, 14, 22, 36, and 40 showed that the control, vehicle-only group had a higher tumor burden than the group treated with 0.5 milligrams of SLT-1A-combo7::αCD38-scFv-1 per kg of body weight per dose. At the final time-point (Day 40), the percentage of BLI for the treated over the vehicle-only control (T/C) was 11%, indicating that there was an 89% reduction of the median tumor burden in the group treated with SLT-1A-combo7::αCD38-scFv-1 (SEQ ID NO:82).

Example 5. Cell-Targeting Molecules Comprising a Shiga Toxin Effector Polypeptide of the Present Invention Linked to a HER2 Binding Region (αHER2-$V_H$H Fused with SLT-1A-Combo(n))

In this example, any one of the Shiga toxin effector polypeptides SLT-1A-combo0-26, as described above, is operably linked to an immunoglobulin binding region anti-HER2, which binds specifically and with high-affinity to an extracellular antigen on human HER2, such as the single-domain variable region of the camelid, antibody 5F7 (αHER2-$V_H$H) as described in U.S. Patent Application Publication 2011/59,090, to form an exemplary, cell-targeting molecule of the present invention.

Construction, Production, and Purification of the Cytotoxic, HER2-Binding, Fusion Protein "SLT-1A-Combo(n)::αHER2-$V_H$H"

For certain embodiments, the immunoglobulin-derived binding region αHER2-$V_H$H and Shiga toxin effector polypeptide are fused together to form a single, continuous polypeptide "SLT-1A-combo(n)::αHER2-$V_H$H." In this example, a polynucleotide encoding αHER2-$V_H$H, a binding region comprising a $V_H$H variable domain derived from the immunoglobulin 5F7, is cloned in frame with a polynucleotide encoding a linker known in the art and in frame with a polynucleotide encoding the Shiga toxin effector polypeptide SLT-1A-combo(n). Expression of the cell-targeting molecule SLT-1A-combo(n)::αHER2-$V_H$H is accomplished using either bacterial and/or cell-free, protein translation systems known to the skilled worker and/or as described in the previous examples.

Determining the In Vitro Characteristics of SLT-1A-Combo (n)::αHER2-$V_H$H

The binding characteristics of the cell-targeting molecule of this example for HER2+ cells and HER2− cells is determined by a fluorescence-based, flow-cytometry. The $B_{max}$ for SLT-1A-combo(n)::αHER2-$V_H$H to HER2+ cells is measured to be approximately 50,000-200,000 MFI with a $K_D$ within the range of 0.01-100 nM, whereas there is no significant binding to HER2− cells in this assay.

The ribosome inactivation abilities of the SLT-1A-combo (n)::αHER2-$V_H$H cell-targeting molecule is determined in a cell-free, in vitro protein translation as described above in the previous examples. The inhibitory effect of the cell-targeting molecule of this example on cell-free protein synthesis is significant. The $IC_{50}$ of SLT-1A-combo(n)::αHER2-$V_H$H on protein synthesis in this cell-free assay is approximately 0.1-100 pM.

Determining the Cytotoxicity of SLT-1A-Combo(n)::αHER2-$V_H$H Using a HER2+ Cell-Kill Assay The cytotoxicity characteristics of SLT-1A-combo(n)::αHER2-$V_H$H is determined by the general cell-kill assay as described above in the previous examples using HER2+ cells. In addition, the selective cytotoxicity characteristics of SLT-1A-combo(n)::αHER2-$V_H$H is determined by the same general cell-kill assay using HER2− cells as a comparison to the HER2+ cells. The CD50 of the cell-targeting molecule of this example is approximately 0.01-100 nM for HER2+ cells depending on the cell line. The $CD_{50}$ of SLT-A-combo(n)::αHER2-$V_H$H is approximately 10-10,000 fold greater (less cytotoxic) for cells not expressing HER2 on a cellular surface as compared to cells which do express HER2 on a cellular surface. In addition, the cytotoxicity of SLT-1A-combo(n)::αHER2-$V_H$H is investigated for both direct cytotoxicity and indirect cytotoxicity by T-cell epitope delivery and presentation leading to CTL-mediated cytotoxicity using assays known to the skilled worker and/or described herein.

Determining the In Vivo Effects of the Exemplary, Cell-Targeting Molecule SLT-1A-Combo(n)::αHER2-$V_H$H Using Animal Models Animal models are used to determine the in vivo effects of the cell-targeting molecule SLT-1A-combo(n)::αHER2-$V_H$H toward neoplastic cells. Various mice strains are used to test the effect of SLT-1A-combo(n)::αHER2-$V_H$H after intravenous administration on xenograft tumors in mice resulting from the injection into those mice of human neoplastic cells which express HER2 on their cell surfaces. Cell killing is investigated for both direct cytotoxicity and indirect cytotoxicity by T-cell epitope delivery and presentation leading to CTL-mediated cytotoxicity using assays known to the skilled worker and/or described herein.

Example 6. Cell-Targeting Molecules Comprising a Shiga Toxin A Subunit Effector Polypeptide of the Present Invention, a Fused, T-Cell Epitope-Peptide, and a Ligand Binding Region Specific to IL-2R In this example, the Shiga toxin effector polypeptide is derived from the A subunit of Shiga-like Toxin 1 (SLT-1A) as described above, optionally with amino acid residue substitutions conferring furin-cleavage resistance, such as, e.g., R248A/R251A (see Example 3, supra). A human, CD8+ T-cell epitope-peptide is selected based on MHC I molecule binding predictions, HLA types, already characterized immunogenicities, and readily available reagents as described above, such as the epitope GVMTRGRLK (SEQ ID NO:560). A binding region is derived from a ligand (the cytokine interleukin 2 or IL-2) for the human interleukin 2 receptor (IL-2R), which is capable of specifically binding an extracellular part of the human IL-2R. IL-2R is a cell-surface receptor expressed by various immune cell types, such as T-cells and natural killer cells.

Construction, Production, and Purification of the Cell-Targeting Fusion Proteins T-Epitope::SLT-1A::IL-2 and IL-2::T-Epitope::SLT-1A The ligand-type binding region αIL-2R, the Shiga toxin effector polypeptide, and T-cell epitope are linked together to form a single, continuous polypeptide, such as "T-epitope::SLT-1A::IL-2" or "IL-2::T-epitope::SLT-1A," and, optionally, a KDEL (SEQ ID NO: 514) is added to the carboxy-terminus of the resulting polypeptide. For example, fusion proteins are produced by expressing from polynucleotides encoding T-epitope::SLT-1A::IL-2 and IL-2::T-epitope::SLT-1A. Expression of the T-epitope::SLT-1A::IL-2 or IL-2::T-epitope::SLT-1A cell-targeting molecules is accomplished using either bacterial and/or cell-free, protein translation systems as described in the previous examples.

Determining the In Vitro Characteristics of the Cell-Targeting Molecules SLT-1A::T-Epitope::IL-2 and IL-2::SLT-1A::T-Epitope The binding characteristics of cell-targeting molecules of this example for IL-2R positive cells and IL-2R negative cells is determined by fluorescence-based, flow-cytometry. The Bmax for both T-epitope::SLT-1A::IL-2 and IL-2::T-epitope::SLT-1A to IL-2R positive cells is measured to be approximately 50,000-200,000 MFI with a $K_D$ within the range of 0.01-100 nM, whereas there is no significant binding to IL-2R negative cells in this assay.

The ribosome inactivation abilities of T-epitope::SLT-1A::IL-2 and IL-2::T-epitope::SLT-1A are determined in a cell-free, in vitro protein translation as described above in the previous examples. The inhibitory effect of the cell-targeting molecules of this example on cell-free protein synthesis is significant. For both T-epitope::SLT-1A::IL-2 and IL-2::T-epitope::SLT-1A, the $IC_{50}$ of on protein synthesis in this cell-free assay is approximately 0.1-100 pM.

Determining the Cytotoxicity of the Cell-Targeting Molecules T-Epitope::SLT-1A::IL-2 or IL-2::T-Epitope::SLT-1A Using a Cell-Kill Assay The cytotoxicity characteristics of T-epitope::SLT-1A::TL-2 or IL-2::T-epitope::SLT-1A are determined by the general cell-kill assay as described above in the previous examples using IL-2R positive cells. In addition, the selective cytotoxicity characteristics of T-epitope::SLT-1A::IL-2 or IL-2::T-epitope::SLT-1A are determined by the same general cell-kill assay using IL-2R negative cells as a comparison to the IL-2R positive cells. The $CD_{50}$ of the cell-targeting molecules of this example is approximately 0.01-100 nM for IL-2R positive cells depending on the cell line. The $CD_{50}$ of T-epitope::SLT-A::IL-2 or IL-2::T-epitope::SLT-1A is approximately 10-10,000 fold greater (less cytotoxic) for cells not expressing IL-2R on a cellular surface as compared to cells which do express TL-2R on a cellular surface. In addition, the cytotoxicity of T-epitope::SLT-1A::IL-2 or IL-2::T-epitope::SLT-1A is investigated for both direct cytotoxicity and indirect cytotoxicity by T-cell epitope delivery and presentation leading to CTL-mediated cytotoxicity using assays known to the skilled worker and/or described herein.

Determining the In Vivo Effects of the Cell-Targeting Molecules T-Epitope::SLT-1A::IL-2 or IL-2::T-Epitope::SLT-1A Using Animal Models Animal models are used to determine the in vivo effects of the cell-targeting molecules T-epitope::SLT-1A::IL-2 and IL-2::T-epitope::SLT-1A on neoplastic cells. Various mice strains are used to test the effect of T-epitope::SLT-A::IL-2 and IL-2::T-epitope::SLT-1A after intravenous administration on xenograft tumors in mice resulting from the injection into those mice of human neoplastic cells which express IL-2R on their cell surfaces. Cell killing is investigated for both direct cytotoxicity and indirect cytotoxicity by T-cell epitope delivery and presentation leading to CTL-mediated cytotoxicity using assays known to the skilled worker and/or described herein.

Example 7. Cell-Targeting Molecules Comprising a Shiga Toxin Effector Polypeptide of the Present Invention Linked to a CEA Binding Region (αCEA-(Fn3) Binding Region Fused with SLT-1A-Combo(n))

In this example, the Shiga toxin effector polypeptide SLT-1A-combo(n), as described above, is operably linked to an immunoglobulin-type, binding region anti-CEA (Fn3) binding region, which binds specifically and with high-affinity to an extracellular antigen on human carcinoembryonic antigen (CEA), such as the tenth human fibronectin type III domain derived binding region C743 as described in Pirie C et al., *J Biol Chem* 286: 4165-72 (2011), to form an exemplary, cell-targeting molecule of the present invention. In addition, an immunogenic, CD8+ T-cell epitope is fused to the amino-terminus of the Shiga toxin effector polypeptide of this example to form epitope-SLT-1A-combo(n).

Construction, Production, and Purification of the Cytotoxic, CEA-Binding, Fusion Protein "αCEA-(Fn3) Fused with Epitope-SLT-1A-Combo(n)"

For certain embodiments, the immunoglobulin-type binding region αCEA-(Fn3) and Shiga toxin effector polypeptide are fused together to form a single, continuous polypeptide "αCEA-(Fn3) fused with epitope-SLT-1A-combo(n)." In this example, a fusion protein "αCEA-(Fn3) fused with epitope-SLT-1A-combo(n)" is designed and produced as described in the previous examples.

Determining the In Vitro Characteristics of "αCEA-(Fn3) Fused with Epitope-SLT-1A-Combo(n)"

The binding characteristics of the cell-targeting molecule of this example for CEA+ cells and CEA− cells is determined by a fluorescence-based, flow-cytometry. The $B_{max}$ for αCEA-(Fn3) fused with epitope-SLT-1A-combo(n) to CEA+ cells is measured to be approximately 50,000-200,000 MFI with a $K_D$ within the range of 0.01-100 nM, whereas there is no significant binding to CEA− cells in this assay.

The ribosome inactivation abilities of the αCEA-(Fn3) fused with epitope-SLT-1A-combo(n) cell-targeting molecule is determined in a cell-free, in vitro protein translation as described above in the previous examples. The inhibitory effect of the cell-targeting molecule of this example on cell-free protein synthesis is significant. The $IC_{50}$ of αCEA-(Fn3) fused with epitope-SLT-1A-combo(n) on protein synthesis in this cell-free assay is approximately 0.1-100 pM.

Determining the Cytotoxicity of "αCEA-(Fn3) Fused with Epitope-SLT-1A-Combo(n)" Using a CEA+ Cell-Kill Assay The cytotoxicity characteristics of αCEA-(Fn3) fused with epitope-SLT-1A-combo(n) is determined by the general cell-kill assay as described above in the previous examples using CEA+ cells. In addition, the selective cytotoxicity characteristics of αCEA-(Fn3) fused with epitope-SLT-1A-combo(n) is determined by the same general cell-kill assay using CEA− cells as a comparison to the CEA+ cells. The $CD_{50}$ of the cell-targeting molecule of this example is approximately 0.01-100 nM for CEA+ cells depending on the cell line. The $CD_{50}$ of αCEA-(Fn3) fused with epitope-SLT-1A-combo(n) is approximately 10-10,000 fold greater (less cytotoxic) for cells not expressing CEA on a cellular surface as compared to cells which do express CEA on a cellular surface. In addition, the cytotoxicity of αCEA-(Fn3) fused with epitope-SLT-1A-combo(n) is investigated for both direct cytotoxicity and indirect cytotoxicity by T-cell epitope delivery and presentation leading to CTL-mediated cytotoxicity using assays known to the skilled worker and/or described herein.

Determining the In Vivo Effects of the Exemplary, Cell-Targeting Molecule "αCEA-(Fn3) Fused with Epitope-SLT-1A-Combo(n)" Using Animal Models Animal models are used to determine the in vivo effects of the cell-targeting molecule αCEA-(Fn3) fused with epitope-SLT-1A-combo(n) toward neoplastic cells. Various mice strains are used to test the effect of αCEA-(Fn3) fused with epitope-SLT-1A-combo(n) after intravenous administration on xenograft tumors in mice resulting from the injection into those mice of human neoplastic cells which express CEA on their cell surfaces. Cell killing is investigated for both direct cytotoxicity and indirect cytotoxicity by T-cell epitope delivery and presentation leading to CTL-mediated cytotoxicity using assays known to the skilled worker and/or described herein.

Example 8. Cytotoxic, Cell-Targeting Molecules Comprising a Shiga Toxin Effector Polypeptide SLT-1A-Combo(n) and the Antibody αHelminth-Intestinal-Antigen In this example, any on the Shiga toxin effector polypeptides SLT-1A-combo0-26, as described above, is operationally linked to an immunoglobulin-type binding region targeting a helminth antigen. An immunoglobulin-type binding region αhelminth-intestinal-antigen is derived from an antibody generated, using techniques known in the art, to the helminth ortholog of a human transferrin receptor (see e.g. the nematode gene gcp-2.1 UniProt G8JYE4_CAEEL; Rosa B et al., *Mol Cell* Proteomics M114.046227 (2015)).

Construction, Production, and Purification of the Cytotoxic, Cell-Targeting Molecule "SLT-1A-Combo(n)::αHelminth-Intestinal-Antigen"

The immunoglobulin-type binding region αhelminth-intestinal-antigen and Shiga toxin effector region, which is optionally a protease-cleavage resistant Shiga toxin effector region, are linked together to form a protein in which the immunoglobulin-type binding region is not located proximally to the protein's amino-terminus as compared to the Shiga toxin effector region. For example, a fusion protein is produced by expressing a polynucleotide encoding an αhelminth-intestinal-antigen-binding protein fused to an amino-terminal SLT-1A-combo0-26. Expression of the SLT-1A-combo(n)::αhelminth-intestinal-antigen-binding protein is accomplished using either bacterial and/or cell-free, protein translation systems as described in the previous examples.

Determining the In Vitro Characteristics of the Cytotoxic, Cell-Targeting Molecule SLT-1A-Combo(n)::αHelminth-Intestinal-Antigen The binding characteristics of the cytotoxic, cell-targeting molecule of this example is determined by a molecular binding assay known in the art using a purified, recombinant, target protein. The $K_D$ for SLT-1A::αhelminth-intestinal-antigen and/or SLT-1A-FR::αhelminth-intestinal-antigen to target protein is measured to be approximately 100 nM, whereas there is no significant binding to a negative control protein (e.g. purified, recombinant, helminth ortholog of human transferrin receptor) in this assay.

The ribosome inactivation abilities of the SLT-A::αhelminth-intestinal-antigen is determined in a cell-free, in vitro protein translation as described above in the previous examples. The inhibitory effect of the cytotoxic, cell-targeting molecule of this example on cell-free protein synthesis is significant. The $IC_{50}$ of SLT-1A::αhelminth-intestinal-antigen on protein synthesis in this cell-free assay is approximately 0.1-100 pM.

Determining the Toxicity of the Cytotoxic, Cell-Targeting Molecule SLT-1A-Combo(n)::αHelminth-Intestinal-Antigen The toxicity of SLT-A::αhelminth-intestinal-antigen to helminths is determined using model helminths (see e.g. Iatsenko I et al., *Toxins* 2050-63 (2014)). The helminth can be administered purified SLT-1A::αhelminth-intestinal-antigen by soaking or alternatively by feeding the helminth with bacteria expressing the SLT-1A::αhelminth-intestinal-antigen fusion protein.

In addition, laboratory animals harboring helminths and/or displaying helminth-related diseases are administered SLT-1A::αhelminth-intestinal-antigen and monitored for reduction or elimination of helminths and/or associated symptoms of parasitic helminth(s).

Example 9. Cell-Targeting Molecules Comprising a Shiga Toxin Effector Polypeptide SLT-1A-Combo(n) Fused to an Immunoglobulin-Type Binding Region Specific to HIV-1 Gag In this example, anyone of the Shiga toxin effector polypeptide SLT-1A-combo0-26, as described above, is operably linked to an immunoglobulin-type binding region αGag-antigen, which is derived from an immunoglobulin-type domain recognizing the HIV capsid protein HIV-1 Gag polyprotein (see e.g. Nagola S et al., *Retrovirology* 9: 17 (2012)) and which comprises an artificial, Ankyrin domain repeat polypeptide capable of binding an extracellular part of Gag. Gag is the major structural protein involved in HIV virus assembly and oligomerizes into a lattice of as many as 700 to 5000 copies per virion to form a conical-shaped CA core (see e.g. Chen Y et al., *Biophys J* 96: 1961-9 (2009); Pornillos O et al., *Nature* 469: 424-7 (2011)).

Construction, Production, and Purification of the Cell-Targeting Molecules "SLT-1A-Combo(n) Linked to αGag"

The immunoglobulin-type binding region αGag and Shiga toxin effector polypeptide SLT-1A-combo(n) are fused to form a cytotoxic protein. For example, a fusion protein is produced by expressing a polynucleotide encoding the αGag-antigen-binding protein SLT-1A-combo(n)::αGag. Expression of the SLT-1A-combo(n)::αGag cytotoxic protein is accomplished using either bacterial and/or cell-free, protein translation systems as described in the previous examples.

Determining the In Vitro Characteristics of the Cell-Targeting Molecule "SLT-1A-Combo(n)::αGag"

The binding characteristics of the cytotoxic protein of this example for purified, recombinant HIV-1 Gag is determined by an assay known in the art, such as an enzyme-linked immunosorbent assay. The $K_D$ for SLT-A-combo(n)::αGag binding to Gag is measured to be approximately within the range of 0.01-100 nanomolar (nM).

The ribosome inactivation abilities of the SLT-A-combo(n)::αGag cytotoxic protein is determined in a cell-free, in vitro protein translation as described above in the previous examples. The inhibitory effect of the cytotoxic protein of this example on cell-free protein synthesis is significant. The $IC_{50}$ of SLT-1A-combo(n)::αGag on protein synthesis in this cell-free assay is approximately 0.1-100 pM.

Determining the Cytotoxicity of the Cell-Targeting Molecule "SLT-1A-Combo(n)::αGag" Using a Cell-Kill Assay The cytotoxicity characteristics of SLT-1A-combo(n)::αGag are determined by the general cell-kill assay as described above in the previous examples using HIV-infected human T-cells. In addition, the selective cytotoxicity characteristics of SLT-1A-combo(n)::αGag are determined by the same general cell-kill assay using uninfected T-cells as a comparison to the infected T-cells. The $CD_{50}$ of the cytotoxic protein of this example is approximately 0.01-100 nM for infected T-cells with actively replicating virus. The $CD_{50}$ of the cytotoxic protein is approximately 10-10,000 fold greater (less cytotoxic) for uninfected T-cells.

Determining the In Vivo Effects of the Cytotoxic, Cell-Targeting Molecule "SLT-1A-Combo(n)::αGag" Using Animal Models The use of SLT-1A-combo(n)::αGag to inhibit the progression of HIV infection is tested by administering SLT-1A-combo(n)::αGag to simian immunodeficiency virus (SIV) infected non-human primates (see Sellier P et al., *PLoS One* 5: e10570 (2010)).

Example 10. A Cytotoxic, Cell-Targeting Molecule Derived from the A Subunit of Shiga Toxin and the Antibody αhistoplasma-Antigen In this example, any one of the Shiga toxin effector polypeptides SLT-1A-combo0-26, as described above, is operably linked to an immunoglobulin-type binding region αhistoplasma-antigen, which is derived from a known antibody or an antibody generated, using techniques known in the art, to a *Histoplasma capsulatum* surface antigen (see e.g., *H. capsulatum* H antigen (Deepe G, Durose G, *Infect Immun* 63: 3151-7 (1995)) and the mAb H1C (Lopes L et al., *Clin Vaccine Immunol* 17: 1155-8 (2010); *H. capsulatum*, cell surface, histone-like protein H2B (Nosanchuk J et al., *J Clin Invest* 112: 1164-1175 (2003))).

Construction, Production, and Purification of the Cytotoxic Cell-Targeting Molecule SLT-1A-Combo(n)::αHistoplasma-Antigen The immunoglobulin-type binding region αhelminth-intestinal-antigen and Shiga toxin effector polypeptide, which is optionally a protease-cleavage resistant Shiga toxin effector region, are linked together to form a protein in which the immunoglobulin-type binding region is not located proximally to the protein's amino-terminus as compared to the Shiga toxin effector polypeptide. For example, a fusion protein is produced by expressing a polynucleotide encoding a *Histoplasma*-surface-antigen-binding protein fused to an amino-terminal, SLT-1A-combo(n). Expression of the SLT-1A-combo(n)::αHistoplasma-antigen-binding protein is accomplished using either bacterial and/or cell-free, protein translation systems as described in the previous examples.

Determining the In Vitro Characteristics of the Cytotoxic, Cell-Targeting Molecule SLT-1A-Combo(n)::αHistoplasma-Antigen The binding characteristics of the cytotoxic, cell-targeting molecule of this example is determined by a molecular binding assay known in the art using a purified recombinant target protein. The $K_D$ for SLT-1A-combo(n)::

αHistoplasma-antigen to target protein (e.g. a purified, recombinant, *H. capsulatum* surface antigen) is measured to be approximately 100 nM, whereas there is no significant binding to a negative control protein in this assay.

The ribosome inactivation abilities of the SLT-A-combo (n)::αHistoplasma-antigen cytotoxic protein is determined in a cell-free, in vitro protein translation as described above in the previous examples. The inhibitory effect of the cytotoxic, cell-targeting molecule of this example on cell-free protein synthesis is significant. The $IC_{50}$ of SLT-1A-combo(n)::αHistoplasma-antigen on protein synthesis in this cell-free assay is approximately 0.1-100 pM.

Determining the Anti-Fungal Activity of the Cytotoxic, Cell-Targeting Molecule SLT-1A-Combo(n):: αHistoplasma-Antigen Using Fungi The fungicidal activity of SLT-A-combo(n):: αHistoplasma-antigen to fungal cells is determined. Purified, StxA::αHistoplasma-antigen and/or StxA-FR:: αHistoplasma-antigen is directly administered to fungal cultures in order to measure fungicidal activity (see e.g. Li R et al., *Antimicrob Agents Chemother* 44: 1734-6 (2000)). In addition, laboratory animals infected with fungi (e.g. *H. capsulatum*) and/or displaying histoplasmosis, systemic mycoses, and/or other *H. capsulatum*-related diseases are administered SLT-1A-combo(n)::αHistoplasma-antigen and monitored for reduction or elimination of fungal pathogens and/or associated symptoms of fungal infections (see e.g. Kobayashi G et al., *Antimicrob Agents Chemother* 34: 524-8 (1990)).

Example 11. Cytotoxic Cell-Targeting Molecules Targeting Various Cell Types

In this example, the Shiga toxin effector region is derived from the A subunit of Shiga-like Toxin 1 (SLT-1A), Shiga toxin (StxA), and/or Shiga-like Toxin 2 (SLT-2A) such that it comprises a combination of sub-regions described herein to provide two or more of the following: 1) de-immunization, 2) protease-cleavage resistance, and/or 3) an embedded or inserted, heterologous, T-cell epitope. A binding region is derived from the molecules chosen from column 1 of Table 21 and which binds the extracellular target biomolecule indicated in column 2 of Table 21. The resulting combination, Shiga toxin effector polypeptides and binding regions are fused together to from various, single-chain polypeptides. The exemplary proteins of this example are optionally created with a carboxy-terminal KDEL-type signal motif using techniques known in the art and optionally linked to an additional exogenous material, such as, a detection promoting agent(s). The exemplary proteins of this example are tested as described in the previous examples using cells expressing the appropriate extracellular target biomolecules. The exemplary proteins of this example may bemused, e.g., to labeling subcellular compartments of target cells and to diagnose and treat diseases, conditions, and/or disorders indicated in column 3 of Table 21.

TABLE 21

Various Binding Regions for Cell-Targeting of Cytotoxic Proteins

| Source of binding region | Extracellular target | Application(s) |
|---|---|---|
| alemtuzumab | CD52 | B-cell cancers, such as lymphoma and leukemia, and B-cell related immune disorders, such as autoimmune disorders |
| basiliximab | CD25 | T-cell disorders, such as prevention of organ transplant rejections, and some B-cell lineage cancers |
| brentuximab | CD30 | hematological cancers, B-cell related immune disorders, and T-cell related immune disorders |
| catumaxomab | EpCAM | various cancers, such as ovarian cancer, malignant ascites, gastric cancer |
| cetuximab | EGFR | various cancers, such as colorectal cancer and head and neck cancer |
| daclizumab | CD25 | B-cell lineage cancers and T-cell disorders, such as rejection of organ transplants |
| daratumumab | CD38 | hematological cancers, B-cell related immune disorders, and T-cell related immune disorders |
| dinutuximab | ganglioside GD2 | Various cancers, such as breast cancer, myeloid cancers, and neuroblastoma |
| efalizumab | LFA-1 (CD11a) | autoimmune disorders, such as psoriasis |
| ertumaxomab | HER2/neu | various cancers and tumors, such as breast cancer and colorectal cancer |
| gemtuzumab | CD33 | myeloid cancer or immune disorder |
| ibritumomab | CD20 | B-cell cancers, such as lymphoma and leukemia, and B-cell related immune disorders, such as autoimmune disorders |
| ipilimumab | CD152 | T-cell related disorders and various cancers, such as leukemia, melanoma |
| muromonab | CD3 | prevention of organ transplant rejections |
| natalizumab | integrin α4 | autoimmune disorders, such as multiple sclerosis and Crohn's disease |
| obinutuzumab | CD20 | B-cell cancers, such as lymphoma and leukemia, and B-cell related immune disorders, such as autoimmune disorders |
| ocaratuzumab | CD20 | B-cell cancers, such as lymphoma and leukemia, and B-cell related immune disorders, such as autoimmune disorders |

TABLE 21-continued

Various Binding Regions for Cell-Targeting of Cytotoxic Proteins

| Source of binding region | Extracellular target | Application(s) |
|---|---|---|
| ocrelizumab | CD20 | B-cell cancers, such as lymphoma and leukemia, and B-cell related immune disorders, such as autoimmune disorders |
| ofatumumab | CD20 | B-cell cancers, such as lymphoma and leukemia, and B-cell related immune disorders, such as autoimmune disorders |
| palivizumab | F protein of respiratory syncytial virus | treat respiratory syncytial virus |
| panitumumab | EGFR | various cancers, such as colorectal cancer and head and neck cancer |
| pertuzumab | HER2/neu | various cancers and tumors, such as breast cancer and colorectal cancer |
| pro 140 | CCR5 | HIV infection and T-cell disorders |
| ramucirumab | VEGFR2 | various cancers and cancer related disorders, such as solid tumors |
| rituximab | CD20 | B-cell cancers, such as lymphoma and leukemia, and B-cell related immune disorders, such as autoimmune disorders |
| tocilizumab or atlizumab | IL-6 receptor | autoimmune disorders, such as rheumatoid arthritis |
| tositumomab | CD20 | B-cell cancers, such as lymphoma and leukemia, and B-cell related immune disorders, such as autoimmune disorders |
| trastuzumab | HER2/neu | various cancers and tumors, such as breast cancer and colorectal cancer |
| ublituximab | CD20 | B-cell cancers, such as lymphoma and leukemia, and B-cell related immune disorders, such as autoimmune disorders |
| vedolizumab | integrin $\alpha4\beta7$ | autoimmune disorders, such as Crohn's disease and ulcerative colitis |
| CD20 binding antibodies and scFv(s) | CD20 | B-cell cancers, such as lymphoma and leukemia, and B-cell related immune disorders, such as autoimmune disorders (see e.g. Geng S et al., Cell Mol Immunol 3:439-43 (2006); Olafesn T et al., Protein Eng Des Sel 23:243-9 (2010)) |
| CD22 binding scFv(s) | CD22 | B-cell cancers or B-cell related immune disorders (see e.g. Kawas S et al., MAbs 3: 479-86 (2011)) |
| CD25 binding scFv(s) | CD25 | various cancers of the B-cell lineage and immune disorders related to T-cells (see e.g. Muramatsu H et al., Cancer Lett 225: 225-36 (2005)) |
| CD30 binding monoclonal antibody(ies) | CD30 | B-cell cancers or B-cell/T-cell related immune disorders (see e.g. Klimka A et al., Br J Cancer 83: 252-60 (2000)) |
| CD33 binding monoclonal antibody(ies) | CD33 | myeloid cancer or immune disorder (see e.g. Benedict C et al., J Immunol Methods 201: 223-31 (1997)) |
| CD38 binding immunoglobul in domains | CD38 | hematological cancers, B-cell related immune disorders, and T-cell related immune disorders (see e.g. U.S. Pat. No. 8,153,765) |
| CD40 binding scFv(s) | CD40 | various cancers and immune disorders (see e.g. Ellmark P et al., Immunology 106: 456-63 (2002)) |
| CD45 binding monoclonal antibody(ies) and scFv(s) | CD45 | Hematological cancers and myelodysplastic syndromes (see e.g. Matthews D et al., Blood 94: 1237-47 (1999); Lin Y et al., Cancer Res 66: 3884-92 (2006); Pagel J etal., Blood 107: 2184-91 (2006)) |
| CD52 binding monoclonal antibody(ies) | CD52 | B-cell cancers, such as lymphoma and leukemia, and B-cell related immune disorders, such as autoimmune disorders (see e.g. U.S. Pat. No. 7,910,104) |
| CD56 binding monoclonal antibody(ies) | CD56 | immune disorders and various cancers, such as lung cancer, Merkel cell carcinoma, myeloma (see e.g. Shin J etal., Hybridoma 18: 521-7 (1999)) |
| CD79 binding monoclonal antibody(ies) | CD79 | B-cell cancers or B-cell related immune disorders (see e.g. Zhang L etal., Ther Immunol 2: 191-202 (1995)) |

TABLE 21-continued

| Various Binding Regions for Cell-Targeting of Cytotoxic Proteins | | |
|---|---|---|
| Source of binding region | Extracellular target | Application(s) |
| CD133 binding monoclonal antibodies and scFv(s) | CD133 | various cancers, hematologic malignancies, and immune disorders (see e.g. Bidlingmaier S et al., JMol Med 86: 1025-32 (2008); Pavlon L etal., J Microsc 231: 374-83 (2008); Rappa G et al., Stem Cells 26: 3008-17 (2008); Swaminathan S etal., J Immunol Methods 361: 110-5 (2010); Wang J etal., Hybridoma 29: 241-9 (2010); Zhu X et al., Mol Cancer Ther 9: 2131-41 (2010); Xia J etal., Sci Rep 3: 3320 (2013)) |
| CD248 binding scFv(s) | CD248 | various cancers, such as inhibiting angiogenesis (see e.g. Zhao A etal., J Immunol Methods 363: 221-32 (2011)) |
| EpCAM binding monoclonal antibody(ies) | EpCAM | various cancers, such as ovarian cancer, malignant ascites, gastric cancer (see e.g. Schanzer J et al., J Immunother 29: 477-88 (2006)) |
| PSMA binding monoclonal antibody(ies) | PSMA | prostate cancer (see e.g. Frigerio B etal., Eur J Cancer 49: 2223-32 (2013)) |
| Eph-B2 binding monoclonal antibody(ies) | Eph-B2 | various cancers such as colorectal cancer and prostate cancer (see e.g. Abéngozar M et al., Blood 119: 4565-76 (2012)) |
| Endoglin binding monoclonal antibody(ies) | Endoglin | various cancers, such as breast cancer and colorectal cancers (see e.g. Völkel T et al., Biochim Biophys Res Acta 1663: 158-66 (2004)) |
| FAP binding monoclonal antibody(ies) | FAP | various cancers, such as sarcomas and bone cancers (see e.g. Zhang Jet al., FASEB J27: 581-9 (2013)) |
| CEA binding antibody(ies) and scFv(s) | CEA | various cancers, such as gastrointestinal cancer, pancreatic cancer, lung cancer, and breast cancer (see e.g. Neumaier M et al., Cancer Res 50: 2128-34 (1990); Pavoni E et al., BMC Cancer 6: 4 (2006); Yazaki P etal., Nucl Med Blot 35: 151-8 (2008); Zhao J et al., Oncol Res 17: 217-22 (2008)) |
| CD24 binding monoclonal antibody(ies) | CD24 | various cancers, such as bladder cancer (see e.g. Kristiansen G et al., Lab Invest 90: 1102-16 (2010)) |
| LewisY antigen binding scFv(s) | LewisY antigens | various cancers, such as cervical cancer and uterine cancer (see e.g. Power B et al., Protein Sci 12: 734-47 (2003); monoclonal antibody BR96 Feridani A etal., Cytometry 71: 361-70 (2007)) |
| adalimumab | TNF-α | various cancers and immune disorders, such as rheumatoid arthritis, Crohn's Disease, plaque psoriasis, psoriatic arthritis, ankylosing spondylitis, juvenile idiopathic arthritis, hemolytic disease of the newborn |
| afelimomab | TNF-α | various cancers and immune disorders |
| ald518 | IL-6 | various cancers and immune disorders, such as rheumatoid arthritis |
| anrukinzumab or ima-638 | IL-13 | various cancers and immune disorders |
| briakinumab | IL-12, IL-23 | various cancers and immune disorders, such as psoriasis, rheumatoid arthritis, inflammatory bowel diseases, multiple sclerosis |
| brodalumab | IL-17 | various cancers and immune disorders, such as inflammatory diseases |
| canakinumab | IL-1 | various cancers and immune disorders, such as rheumatoid arthritis |
| certolizumab | TNF-α | various cancers and immune disorders, such as Crohn's disease |
| fezakinumab | IL-22 | various cancers and immune disorders, such as rheumatoid arthritis, psoriasis |
| ganitumab | IGF-I | various cancers |
| golimumab | TNF-α | various cancers and immune disorders, such as rheumatoid arthritis, psoriatic arthritis, ankylosing spondylitis |
| infliximab | TNF-α | various cancers and immune disorders, such as rheumatoid arthritis, ankylosing spondylitis, psoriatic arthritis, psoriasis, Crohn's disease, ulcerative colitis |

TABLE 21-continued

Various Binding Regions for Cell-Targeting of Cytotoxic Proteins

| Source of binding region | Extracellular target | Application(s) |
|---|---|---|
| ixekizumab | IL-17A | various cancers and immune disorders, such as autoimmune diseases |
| mepolizumab | IL-5 | various immune disorders and cancers, such as B-cell cancers |
| nerelimomab | TNF-α | various cancers and immune disorders |
| olokizumab | IL6 | various cancers and immune disorders |
| ozoralizumab | TNF-α | inflammation |
| perakizumab | IL17A | various cancers and immune disorders, such as arthritis |
| placulumab | human TNF | various immune disorders and cancers |
| sarilumab | IL6 | various cancers and immune disorders, such as rheumatoid arthritis, ankylosing spondylitis |
| siltuximab | IL-6 | various cancers and immune disorders |
| sirukumab | IL-6 | various cancers and immune disorders, such as rheumatoid arthritis |
| tabalumab | BAFF | B-cell cancers |
| ticilimumab or tremelimumab | CTLA-4 | various cancers |
| tildrakizumab | IL23 | immunologically mediated inflammatory disorders |
| tnx-650 | IL-13 | various cancers and immune disorders, such as B-cell cancers |
| tocilizumab or atlizumab | IL-6 | receptor various cancers and immune disorders, such as rheumatoid arthritis |
| ustekinumab | IL-12, IL-23 | various cancers and immune disorders, such as multiple sclerosis, psoriasis, psoriatic arthritis |
| Various growth factors: VEGF, EGF1, EGF2, FGF | VEGFR, EGFR, FGFR | various cancer, such as breast cancer and colon cancer, and to inhibit vascularization |
| Various cytokines: IL-2, IL-6, IL-23, CCL2, BAFFs, TNFs, RANKL | IL-2R, IL-6R, IL-23R, CD80/CD86, TNFRSF13/TNFRSF17, TNFR | various immune disorders and cancers |
| Broadly neutralizing antibodies identified from patient samples | Influenza surface antigens (e.g. hemaglutinins and matrix protein 2) | viral infections (see e.g. Prabakaran P et al., Front Microbiol 3: 277 (2012)) |
| Broadly neutralizing antibodies identified from patient samples | Coronavirus surface antigens | viral infections (see e.g. Prabakaran P et al., Front Microbiol 3: 277 (2012)) |
| Various antibodies | Filovirus surface antigens (e.g. VP35, VP40, and glycoprotein) | viral infections (see e.g. Olinger G et al., Proc Natl Acad Sci USA 109: 18030-5 (2012); Pettitt J et al., Sci Transl Med 5: 199ra113 (2013); Stahelin R, Expert Opin Ther Targets 18: 115-20 (2014); Becquart P et al., PLoS One 9: e96360 (2014); Stahelin R, Fron Microbiol 5: 300 (2014); Tran E et al., J Virol 88: 10958-62 (2014); Murin C et al., Proc Natl Acad Sci USA 111: 17182-7 (2014)) |
| Broadly neutralizing antibodies identified from patient samples | Henipavirus surface antigens | viral infections (see e.g. Prabakaran P et al., Front Microbiol 3: 277 (2012)) |
| Various antibodies including broadly neutralizing antibodies and scFvs | HIV surface antigens (e.g. matrix protein Map17) | viral infections (see e.g. Kitidee K et al., BMC Biotechnol 10: 80 (2010); Yu L, Guan Y, Front Immunol 5: 250 (2014)) |

While some embodiments of the invention have been described by way of illustration, it will be apparent that the invention may be put into practice with many modifications, variations and adaptations, and with the use of numerous equivalents or alternative solutions that are within the scope of persons skilled in the art, without departing from the spirit of the invention or exceeding the scope of the claims.

All publications, patents, and patent applications are herein incorporated by reference in their entirety to the same extent as if each individual publication, patent or patent application was specifically and individually indicated to be incorporated by reference in its entirety. The international patent application publications WO 2014/164680, WO 2014/164693, WO 2015/138435, WO 2015/138452, WO 2015/113005, WO 2015/113007, and WO 2015/191764, are each incorporated herein by reference in its entirety. The disclosures of U.S. patent applications US20150259428; 62/168,758; 62/168,759; 62/168,760; 62/168,761; 62/168,762; and 62/168,763 are each incorporated herein by reference in its entirety. The disclosure of international PCT patent application serial number PCT/US2016/016580 is incorporated herein by reference in its entirety. The complete disclosures of all electronically available biological sequence information from GenBank (National Center for Biotechnology Information, U.S.) for amino acid and nucleotide sequences cited herein are each incorporated herein by reference in their entirety.

Sequence Listing

| ID Number | Text Description | Biological Sequence |
|---|---|---|
| SEQ ID NO: 1 | Shiga-like toxin 1 Subunit A (SLT-1A) | KEFTLDFSTAKTYVDSLNVIRSAIGTPLQTISSGGT<br>SLLMIDSGSGDNLFAVDVRGIDPEEGRFNNLRLIV<br>ERNNLYVTGFVNRTNNVFYRFADFSHVTFPGTTA<br>VTLSGDSSYTTLQRVAGISRTGMQINRHSLTTSYL<br>DLMSHSGTSLTQSVARAMLRFVTVTAEALRFRQI<br>QRGFRTTLDDLSGRSYVMTAEDVDLTLNWGRLS<br>SVLPDYHGQDSVRVGRISFGSINAILGSVALILNCH<br>HHASRVARMASDEFPSMCPADGRVRGITHNKILW<br>DSSTLGAILMRRTISS |
| SEQ ID NO: 2 | Shiga toxin Subunit A | KEFTLDFSTAKTYVDSLNVIRSAIGTPLQTISSGGT<br>SLLMIDSGTGDNLFAVDVRGIDPEEGRFNNLRLIV<br>ERNNLYVTGFVNRTNNVFYRFADFSHVTFPGTTA<br>VTLSGDSSYTTLQRVAGISRTGMQINRHSLTTSYL<br>DLMSHSGTSLTQSVARAMLRFVTVTAEALRFRQI<br>QRGFRTTLDDLSGRSYVMTAEDVDLTLNWGRLS<br>SVLPDYHGQDSVRVGRISFGSINAILGSVALILNCH<br>HHASRVARMASDEFPSMCPADGRVRGITHNKILW<br>DSSTLGAILMRRTISS |
| SEQ ID NO: 3 | Shiga-like toxin 2 Subunit A (SLT-2A) | DEFTVDFSSQKSYVDSLNSIRSAISTPLGNISQGGV<br>SVSVINHVLGGNYISLNVRGLDPYSERFNHLRLIM<br>ERNNLYVAGFINTETNIFYRFSDFSHISVPDVITVS<br>MTTDSSYSSLQRIADLERTGMQIGRHSLVGSYLDL<br>MEFRGRSMTRASSRAMLRFVTVIAEALRFRQIQR<br>GFRPALSEASPLYTMTAQDVDLTLNWGRISNVLP<br>EYRGEEGVRIGRISFNSLSAILGSVAVILNCHSTGS<br>YSVRSVSQKQKTECQIVGDRAAIKVNNVLWEAN<br>TIAALLNRKPQDLTEPNQ |
| SEQ ID NO: 4 | Shiga toxin effector polypeptide SLT-1A-WT | KEFTLDFSTAKTYVDSLNVIRSAIGTPLQTISSGGT<br>SLLMIDSGSGDNLFAVDVRGIDPEEGRFNNLRLIV<br>ERNNLYVTGFVNRTNNVFYRFADFSHVTFPGTTA<br>VTLSGDSSYTTLQRVAGISRTGMQINRHSLTTSYL<br>DLMSHSGTSLTQSVARAMLRFVTVTAEALRFRQI<br>QRGFRTTLDDLSGRSYVMTAEDVDLTLNWGRLS<br>SVLPDYHGQDSVRVGRISFGSINAILGSVALILNCH<br>HHASRVAR |
| SEQ ID NO: 5 | Shiga toxin effector polypeptide SLT-1A-FR | KEFTLDFSTAKTYVDSLNVIRSAIGTPLQTISSGGT<br>SLLMIDSGSGDNLFAVDVRGIDPEEGRFNNLRLIV<br>ERNNLYVTGFVNRTNNVFYRFADFSHVTFPGTTA<br>VTLSGDSSYTTLQRVAGISRTGMQINRHSLTTSYL<br>DLMSHSGTSLTQSVARAMLRFVTVTAEALRFRQI<br>QRGFRTTLDDLSGRSYVMTAEDVDLTLNWGRLS<br>SVLPDYHGQDSVRVGRISFGSINAILGSVALILNCH<br>HHASAVAA |
| SEQ ID NO: 6 | Shiga toxin effector polypeptide SLT-1A-combo0 | KEFTLDFSTAKTYVDSLNVIRSAIGTPLQTISSGGT<br>SLLMIDSGSGDNLFAVDVRGIDPEEGRFNNLRLIV<br>ERNNLYVTGFVNRTNNVFYRFADFSHVTFPGTNL<br>VPMVATVSYTTLQRVAGISRTGMQINRHSLTTSY<br>LDLMSHSGTSLTQSVARAMLRFVTVTAEALRFRQ<br>IQRGFRTTLDDLSGRSYVMTAEDVDLTLNWGRLS<br>SVLPDYHGQDSVRVGRISFGSINAILGSVALILNCH<br>HHASAVAA |
| SEQ ID NO: 7 | Shiga toxin effector polypeptide SLT-1A-combo1 | KEFTLDFSTAKTYVDSLNVIRSAIGTPLQTISSGGT<br>SLLMIDSGSGDNLFAVDILGFDFTLGRFNNLRLIVE<br>RNNLYVTGFVNRTNNVFYRFADFSHVTFPGTTAV<br>TLSGDSSYTTLQRVAGISRTGMQINRHSLTTSYLD |

-continued

Sequence Listing

| ID Number | Text Description | Biological Sequence |
|---|---|---|
| | | LMSHSGTSLTQSVARAMLRFVTVTAEALRFRQIQ<br>RGFRTTLDDLSGRSYVMTAEDVDLTLNWGRLSS<br>VLPDYHGQDSVRVGRISFGSINAILGSVALILNCH<br>HHASAVAA |
| SEQ ID NO: 8 | Shiga toxin effector polypeptide SLT-1A-combo2 | KEFTLDFSTAKTYVDSLNVIRSAIGTPLQTISSGGT<br>SLLMIDSGIGDNLFAVDILGFDFTLGRFNNLRLIVE<br>RNNLYVTGFVNRTNNVFYRFADFSHVTFPGTTAV<br>TLSGDSSYTTLQRVAGISRTGMQINRHSLTTSYLD<br>LMSHSGTSLTQSVARAMLRFVTVTAEALRFRQIQ<br>RGFRTTLDDLSGRSYVMTAEDVDLTLNWGRLSS<br>VLPDYHGQDSVRVGRISFGSINAILGSVALILNSFIH<br>HASAVAA |
| SEQ ID NO: 9 | Shiga toxin effector polypeptide SLT-1A-combo3 | KEFTLDFSTAKTYVDSLNVIRSAIGTPLQTISSGGT<br>SLLMIDSGSGDNLFAVNLVPMVATVGRFNNLRLI<br>VERNNLYVTGFVNRTNNVFYRFADFSHVTFPGTT<br>AVTLSGDSSYTTLQRVAGISRTGMQINRHSLTTSY<br>LDLMSHSGTSLTQSVARAMLRFVTVTAEALRFRQ<br>IQRGFRTTLDDLSGRSYVMTAEDVDLTLNWGRLS<br>SVLPDYHGQDSVRVGRISFGSINAILGSVALILNCH<br>HHASAVAA |
| SEQ ID NO: 10 | Shiga toxin effector polypeptide SLT-1A-combo4 | KEFTLDFSTAKTYVDSLNVIRSAIGTPLQTISSGGT<br>SLLMIDNLVPMVATVVDVRGIDPEEGRFNNLRLIV<br>ERNNLYVTGFVNRTNNVFYRFADFSHVTFPGTTA<br>VTLSGDSSYTTLQRVAGISRTGMQINRHSLTTSYL<br>DLMSHSGTSLTQSVARAMLRFVTVTAEALRFRQI<br>QRGFRTTLDDLSGRSYVMTAEDVDLTLNWGRLS<br>SVLPDYHGQDSVRVGRISFGSINAILGSVALILNCH<br>HHASAVAA |
| SEQ ID NO: 11 | Shiga toxin effector polypeptide SLT-1A-combo5 | KEFTLDFSTAKTYVDSLNVIRSAIGTPLQTISSGGT<br>SLLMIDSGIGDNLFAVDILGFDFTLGRFNNLRLIVE<br>RNNLYVTGFVNRTNNVFYRFADFSHVTFPGTTAV<br>TLSADSSYTTLQRVAGISRTGMQINRHSLTTSYLD<br>LMSHSGTSLTQSVARAMLRFVTVTAEALRFRQIQ<br>RGFRTTLDDLSGASYVMTAEDVDLTLNWGRLSS<br>VLPDYHGQDSVRVGRISFGSINAILGSVALILNCH<br>HHASRVAR |
| SEQ ID NO: 12 | Shiga toxin effector polypeptide SLT-1A-combo6 | KEFTLDFSTAKTYVDSLNVIRSAIGTPLQTISSGGT<br>SLLMIDSGIGDNLFAVDILGFDFTLGRFNNLRLIVE<br>RNNLYVTGFVNRTNNVFYRFADFSHVTFPGTTAV<br>TLSADSSYTTLQRVAGISRTGMQINRHSLTTSYLD<br>LMSHSATSLTQSVARAMLRFVTVTAEALRFRQIQ<br>RGFRTTLDDLSGASYVMTAEDVDLTLNWGRLSS<br>VLPDYHGQDSVRVGRISFGSINAILGSVALILNCH<br>HHASRVAR |
| SEQ ID NO: 13 | Shiga toxin effector polypeptide SLT-1A-combo7 | KEFTLDFSTAKTYVDSLNVIRSAIGTPLQTISSGGT<br>SLLMIDSGIGDNLFAVDILGFDFTLGRFNNLRLIVE<br>RNNLYVTGFVNRTNNVFYRFADFSHVTFPGTTAV<br>TLSADSSYTTLQRVAGISRTGMQINRHSLTTSYLD<br>LMSHSGTSLTQSVARAMLRFVTVTAEALRFRQIQ<br>RGFRTTLDDLSGASYVMTAEDVDLTLNWGRLSS<br>VLPDYHGQDSVRVGRISFGSINAILGSVALILNSFIH<br>HASAVAA |
| SEQ ID NO: 14 | Shiga toxin effector polypeptide SLT-1A-combo8 | KEFTLDFSTAKTYVDSLNVIRSAIGTPLQTISSGGT<br>SLLMIDSGIGDNLFAVDILGFVFTLGRFNNLRLIVE<br>RNNLYVTGFVNRTNNVFYRFADFSHVTFPGTTAV<br>TLSADSSYTTLQRVAGISRTGMQINRHSLTTSYLD<br>LMSHSGTSLTQSVARAMLRFVTVTAEALRFRQIQ<br>RGFRTTLDDLSGASYVMTAEDVDLTLNWGRLSS<br>VLPDYHGQDSVRVGRISFGSINAILGSVALILNSFIH<br>HASAVAA |
| SEQ ID NO: 15 | Shiga toxin effector polypeptide SLT-1A-combo9 | KEFTLDFSTAKTYVDSLNVIRSAIGTPLQTISSGGT<br>SLLMIDSGIGDNLFAVGILGFDFTLGRFNNLRLIVE<br>RNNLYVTGFVNRTNNVFYRFADFSHVTFPGTTAV<br>TLSADSSYTTLQRVAGISRTGMQINRHSLTTSYLD |

-continued

Sequence Listing

| ID Number | Text Description | Biological Sequence |
|---|---|---|
| | | LMSHSGTSLTQSVARAMLRFVTVTAEALRFRQIQ RGFRTTLDDLSGASYVMTAEDVDLTLNWGRLSS VLPDYHGQDSVRVGRISFGSINAILGSVALILNSFIH HASAVAA |
| SEQ ID NO: 16 | Shiga toxin effector polypeptide SLT-1A-combo10 | KEFTLDFSTAKTYVDSLNVIRSAIGTPLQTISSGGT SLLMIDSGIGDNLFAVDILGFDFTLGRFNNLRLIVE RNNLYVTGFVNRTNNVFYRFADFSHVTFPGTTAV TLSADSSYTTLQRVAGISRTGMQINRHSLTTSYLD LMSHSATSLTQSVARAMLRFVTVTAEALRFRQIQ RGFRTTLDDLSGRSYVMTAEDVDLTLNWGRLSS VLPDYHGQDSVRVGRISFGSINAILGSVALILNSFIH HASAVAA |
| SEQ ID NO: 17 | Shiga toxin effector polypeptide SLT-1A-combo11 | KEFTLDFSTAKTYVDSLNVIRSAIGTPLQTISSGGT SLLMIDSGIGDNLFAVGILGFVFTLGRFNNLRLIVE RNNLYVTGFVNRTNNVFYRFADFSHVTFPGTTAV TLSADSSYTTLQRVAGISRTGMQINRHSLTTSYLD LMSHSGTSLTQSVARAMLRFVTVTAEALRFRQIQ RGFRTTLDDLSGASYVMTAEDVDLTLNWGRLSS VLPDYHGQDSVRVGRISFGSINAILGSVALILNSFIH HASAVAA |
| SEQ ID NO: 18 | Shiga toxin effector polypeptide SLT-1A-combo12 | AEFTLDFSTAKTYVDSLNVIRSAIGTPLQTISSGGT SLLMIDSGIGDNLFAVDILGFDFTLGRFNNLRLIVE RNNLYVTGFVNRTNNVFYRFADFSHVTFPGTTAV TLSADSSYTTLQRVAGISRTGMQINRHSLTTSYLD LMSHSATSLTQSVARAMLRFVTVTAEALRFRQIQ RGFRTTLDDLSGRSYVMTAEDVDLTLNWGRLSS VLPDYHGQDSVRVGRISFGSINAILGSVALILNSFIH HASAVAA |
| SEQ ID NO: 19 | Shiga toxin effector polypeptide SLT-1A-combo13 | KEFTLDFSTAKTYVDSLNVIRSAIGTPLQTISSGGT SLLMIDSGIGDNLFAVDILGFDFTLGRFNNLRLIVE RNNLYVTGFVNRTNNVFYRFADFSHVTFPGTTAV TLSGDSSYTTLQRVAGISRTGMQINRHSLTTSYLD LMSHSGTSLTQSVARAMLRFVTVTAEALRFRQIQ RGFRGILGDVFTRSYVMTAEDVDLTLNWGRLSSV LPDYHGQDSVRVGRISFGSINAILGSVALILNSHHH ASAVAA |
| SEQ ID NO: 20 | Shiga toxin effector polypeptide SLT-1A-combo14 | KEFTLDFSTAKTYVDSLNVIRSAIGTPLQTISSGGT SLLMIDSGIGDNLFAVDILGFDFTLGRFNNLRLIVE RNNLYVTGFVNRTNNVFYRFADFSHVTFPGTTAV TLSADSSYTTLQRVAGISRTGMQINRHSLTTSYLD LMSHSATSLTQSVARAMLRFVTVTAEALRFRQIQ RGFRTTLDDLSGASYVMTAEDVDLTLNWGRLSS VLPDYHGQDSVRVGRISFGSINAILGSVALILNSFIH HASAVAA |
| SEQ ID NO: 21 | Shiga toxin effector polypeptide SLT-1A-combo15 | AEFTLDFSTAKTYVDSLNVIRSAIGTPLQTISSGGT SLLMIDSGIGDNLFAVDILGFDFTLGRFNNLRLIVE RNNLYVTGFVNRTNNVFYRFADFSHVTFPGTTAV TLSADSSYTTLQRVAGISRTGMQINRHSLTTSYLD LMSHSATSLTQSVARAMLRFVTVTAEALRFRQIQ RGFRTTLDDLSGASYVMTAEDVDLTLNWGRLSS VLPDYHGQDSVRVGRISFGSINAILGSVALILNSFIH HASAVAA |
| SEQ ID NO: 22 | Shiga toxin effector polypeptide SLT-1A-combo16 | KEFILDFSTAKTYVDSLNVIRSAIGTPLQTISSGGTS LLMIDSGIGDNLFAVDILGFDFTLGRFNNLRLIVER NNLYVTGFVNRTNNVFYRFADFSHVTFPGTTAVT LSADSSYTTLQRVAGISRTGMQINRHSLTTSYLDL MSHSATSLTQSVARAMLRFVTVTAEALRFRQIQR GFRTTLDDLSGASYVMTAEDVDLTLNWGRLSSV LPDYHGQDSVRVGRISFGSINAILGSVALILNSHHH ASAVAA |
| SEQ ID NO: 23 | Shiga toxin effector polypeptide SLT-1A-combo17 | AEFILDFSTAKTYVDSLNVIRSAIGTPLQTISSGGTS LLMIDSGIGDNLFAVDILGFDFTLGRFNNLRLIVER NNLYVTGFVNRTNNVFYRFADFSHVTFPGTTAVT LSADSSYTTLQRVAGISRTGMQINRHSLTTSYLDL |

-continued

Sequence Listing

| ID Number | Text Description | Biological Sequence |
|---|---|---|
| | | MSHSATSLTQSVARAMLRFVTVTAEALRFRQIQR GFRTTLDDLSGASYVMTAEDVDLTLNWGRLSSV LPDYHGQDSVRVGRISFGSINAILGSVALILNSHHH ASAVAA |
| SEQ ID NO: 24 | Shiga toxin effector polypeptide SLT-1A-combo18 | AEFILDFSTAKTYVDSLNVIRSAIGTPLQTISSGGTS LLMIDSGIGDNLFAVNLVPMVATVGRFNNLRLIV ERNNLYVTGFVNRTNNVFYRFADFSHVTFPGTTA VTLSADSSYTTLQRVAGISRTGMQINRHSLTTSYL DLMSHSATSLTQSVARAMLRFVTVTAEALRFRQI QRGFRTTLDDLSGASYVMTAEDVDLTLNWGRLS SVLPDYHGQDSVRVGRISFGSINAILGSVALILNSH HHASAVAA |
| SEQ ID NO: 25 | Shiga toxin effector polypeptide SLT-1A-combo19 | KEFILDFSTAKTYVDSLNVIRSAIGTPLQTISSGGTS LLMIDSGIGDNLFAVDVRGIAPIEARFNNLRLIVER NNLYVTGFVNRTNNVFYRFADFSHVTFPGTTAVT LSADSSYTTLQRVAGISRTGMQINRHSLTTSYLDL MSHSATSLTQSVARAMLRFVTVTAEALRFRQIQR GFRTTLAALSGASYVMTAEDVDLTLNWGRLSSV LPDYHGQDSVRVGRISFGSINAILGSVALILNSHHH ASAVAA |
| SEQ ID NO: 26 | Shiga toxin effector polypeptide SLT-1A-combo20 | KEFTLDFSTAKTYVDSLNVIRSAIGTPLQTISSGGT SLLMIDSGIGDNLFAVDILGFDFTLGRFNNLRLIVE RNNLYVTGFVNRTNNVFYRFADFSHVTFPGTTAV TLSADSSYTTLQRVAGISRTGMQINRHSLTTSYLD LMSHSATSLTQSVARAMLRFVTVTAEALRFRQIQ RGFRTTLDDLSGRSYVMTAEDVDLTLNWGRLSS VLPDYHGQDSVRVGRISFGSINAILGSVALILNSFIH HARNLVPMVATVASAVAA |
| SEQ ID NO: 27 | Shiga toxin effector polypeptide SLT-1A-combo21 | KEFTLDFSTAKTYVDSLNVIRSAIGTPLQTISSGGT SLLMIDSGIGDNLFAVDILGFDFTLGRFNNLRLIVE RNNLYVTGFVNATNNVFYRFADFSHVTFPGTTAV TLSADSSYTTLQRVAGISRTGMQINRHSLTTSYLD LMSHSGTSLTQSVARAMLRFVTVTAEALRFRQIQ RGFRTTLDDLSGASYVMTAEDVDLTLNWGRLSS VLPDYHGQDSVRVGRISFGSINAILGSVALILNSFIH HASAVAA |
| SEQ ID NO: 28 | Shiga toxin effector polypeptide SLT-1A-combo22 | KEFTLDFSTAKTYVDSLNVIRSAIGTPLQTISSGGT SLLMIDSGSGDNLFAVDVRGIAPEEGRFNNLRLIV ERNNLYVTGFVNRTNNVFYRFADFSHVTFPGTTA VTLSADSSYTTLQRVAGISRTGMQINRHSLTTSYL DLMSHSATSLTQSVARAMLRFVTVTAEALRFRQI QRGFRTTLDDLSGASYVMTAEDVDLTLNWGRLS SVLPDYHGQDSVRVGRISFGSINAILGSVALILNSH HHASAVAA |
| SEQ ID NO: 29 | Shiga toxin effector polypeptide SLT-1A-combo23 | KEFTLDFSTAKTYVDSLNVIRSAIGTPLQTISSGGT SLLMIDSGIGDNLFAVDILGFDFTLGRFNNLRLIVE RNNLYVTGFVNRTNNAFYRFADFSHVTFPGTTAV TLSADSSYTTLQRVAGISRTGMQINRHSLTTSYLD LMSHSGTSLTQSVARAMLRFVTVTAEALRFRQIQ RGFRTTLDDLSGASYVMTAEDVDLTLNWGRLSS VLPDYHGQDSVRVGRISFGSINAILGSVALILNSFIH HASAVAA |
| SEQ ID NO: 30 | Shiga toxin effector polypeptide SLT-1A-combo24 | KEFTLDFSTAKTYVDSLNVIRSAIGTPLQTISSGGT SLLMIDSGIGDNLFAVDILGFDFTLGRFNNLRLIVE RNNLYVTGFVNRTNNVFYRFADFSHVTFPGTTAV TLSADSSYTTLQRVAGISRTGMQINRHSLTTSYLD LMSHSGTSLTQSAARAMLRFVTVTAEALRFRQIQ RGFRTTLDDLSGASYVMTAEDVDLTLNWGRLSS VLPDYHGQDSVRVGRISFGSINAILGSVALILNSFIH HASAVAA |
| SEQ ID NO: 31 | Shiga toxin effector polypeptide SLT-1A-combo25 | KEFTLDFSTAKTYVDSLNVIRSAIGTPLQTISSGGT SLLMIDSGIGDNLFAVDILGFDFTLGRFNNLRLIVE RNNLYVTGFVNRTNNVFYRFADFSHVTFPGTTAV TLSADSSYTTLQRVAGISRTGMQINRHSLTTSYLA |

-continued

| Sequence Listing | | |
|---|---|---|
| ID Number | Text Description | Biological Sequence |
| | | LMSHSGTSLTQSVARAMLRFVTVTAEALRFRQIQ RGFRTTLDDLSGASYVMTAEDVDLTLNWGRLSS VLPDYHGQDSVRVGRISFGSINAILGSVALILNSFIH HASAVAA |
| SEQ ID NO: 32 | Shiga toxin effector polypeptide SLT-1A-combo26 | KEFTLDFSTAKTYVDSLNVIRSAIGTPLQTISSGGT SLLMIDSGIGDNLFAVDILGFDFTLGRFNNLRLIVE RNNLYVTGFVNRTNNVFYRFADFSHVTFPGTTAV TLSADSSYTTLQRVAGISRTGMQINRHSLTTSYLD LMSHSGTSLTQSVARAMLRFVTVTAEALRFRQIQ RGFRTTLDDLSGASYVMTAEDVALTLNWGRLSS VLPDYHGQDSVRVGRISFGSINAILGSVALILNSFIH HASAVAA |
| SEQ ID NO: 33 | scFv-3::SLT-1A-WT | MQVQLQQPGAELVKPGASVKMSCKTSGYTFTSYN VHWVKQTPGQGLEWIGAIYPGNGDTSFNQKFKGK ATLTADKSSSTVYMQLSSLTSEDSAVYYCARSNYY GSSYVWFFDVWGAGTTVTVSSGSTSGSGKPGSGEG SQIVLSQSPTILSASPGEKVTMTCRASSSVSYMDWY QQKPGSSPKPWIYATSNLASGVPARFSGSGSGTSYS LTISRVEAEDAATYYCQQWISNPPTFGAGTKLELKE FPKPSTPPGSSGGAPKEFTLDFSTAKTYVDSLNVIRS AIGTPLQTISSGGTSLLMIDSGSGDNLFAVDVRGIDP EEGRFNNLRLIVERNNLYVTGFVNRTNNVFYRFADF SHVTFPGTTAVTLSGDSSYTTLQRVAGISRTGMQIN RHSLTTSYLDLMSHSGTSLTQSVARAMLRFVTVTA EALRFRQIQRGFRTTLDDLSGRSYVMTAEDVDLTLN WGRLSSVLPDYHGQDSVRVGRISFGSINAILGSVALI LNCHHHASRVAR |
| SEQ ID NO: 34 | SLT-1A-FR::scFv-1 | MKEFTLDFSTAKTYVDSLNVIRSAIGTPLQTISSGGT SLLMIDSGSGDNLFAVDVRGIDPEEGRFNNLRLIVER NNLYVTGFVNRTNNVFYRFADFSHVTFPGTTAVTL SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASAVAAE FPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGGGGSQVQLQESGPGLVRPSQTLS LTCTVSGFSLTSYGVHWVRQPPGRGLEWIGVMWR GGSTDYNAAFMSRLNITKDNSKNQVSLRLSSVTAA DTAVYYCAKSMITTGFVMDSWGQGSLVTVSS |
| SEQ ID NO: 35 | SLT-1A-FR::scFv-2 | MKEFTLDFSTAKTYVDSLNVIRSAIGTPLQTISSGGT SLLMIDSGSGDNLFAVDVRGIDPEEGRFNNLRLIVER NNLYVTGFVNRTNNVFYRFADFSHVTFPGTTAVTL SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASAVAAE FPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGSTSGSGKPGSGEGSTKGQVQLQE SGPGLVRPSQTLSLTCTVSGFSLTSYGVHWVRQPPG RGLEWIGVMWRGGSTDYNAAFMSRLNITKDNSKN QVSLRLSSVTAADTAVYYCAKSMITTGFVMDSWG QGSLVTVSSA |
| SEQ ID NO: 36 | SLT-1A-FR::scFv-4 | MKEFTLDFSTAKTYVDSLNVIRSAIGTPLQTISSGGT SLLMIDSGSGDNLFAVDVRGIDPEEGRFNNLRLIVER NNLYVTGFVNRTNNVFYRFADFSHVTFPGTTAVTL SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASAVAAE FPKPSTPPGSSGGAPDIQMTQSPSSLSASVGDRVTIT CRASQDVNTAVAWYQQKPGKAPKLLIYSASFLYSG VPSRFSGSRSGTDFTLTISSLQPEDFATYYCQQHYTT PPTFGQGTKVEIKGGGGSGGGGSGGGGSGGGGSGG |

-continued

| Sequence Listing | | |
|---|---|---|
| ID Number | Text Description | Biological Sequence |
| | | GGSEVQLVESGGGLVQPGGSLRLSCAASGFNIKDTY IHWVRQAPGKGLEWVARIYPTNGYTRYADSVKGRF TISADTSKNTAYLQMNSLRAEDTAVYYCSRWGGD GFYAMDYWGQGTLVTVSSA |
| SEQ ID NO: 37 | SLT-1A-FR::scFv-5 | MKEFTLDFSTAKTYVDSLNVIRSAIGTPLQTISSGGT SLLMIDSGSGDNLFAVDVRGIDPEEGRFNNLRLIVER NNLYVTGFVNRTNNVFYRFADFSHVTFPGTTAVTL SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASAVAAE FPKPSTPPGSSGGAPDIQMTQSPSSLSASVGDRVTIT CRASQGISSWLAWYQQKPEKAPKSLIYAASSLQSGV PSRFSGSGSGTDFTLTISSLQPEDFATYYCQQYNSYP YTFGQGTKLEIKGGGGSQVQLVQSGAEVKKPGASV KVSCKASGYTFTSYDVHWVRQAPGQRLEWMGWL HADTGITKFSQKFQGRVTITRDTSASTAYMELSSLRS EDTAVYYCARERIQLWFDYWGQGTLVTVSS |
| SEQ ID NO: 38 | SLT-1A-FR::scFv-6 | MKEFTLDFSTAKTYVDSLNVIRSAIGTPLQTISSGGT SLLMIDSGSGDNLFAVDVRGIDPEEGRFNNLRLIVER NNLYVTGFVNRTNNVFYRFADFSHVTFPGTTAVTL SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASAVAAE FPKPSTPPGSSGGAPEVQLVESGGGLVQPGGSLRLS CAASGFTFSDSWIHWVRQAPGKGLEWVAWISPYGG STYYADSVKGRFTISADTSKNTAYLQMNSLRAEDT AVYYCARRHWPGGFDYWGQGTLVTVSSGGGGSDI QMTQSPSSLSASVGDRVTITCRASQDVSTAVAWYQ QKPGKAPKLLIYSASFLYSGVPSRFSGSGSGTDFTLT ISSLQPEDFATYYCQQYLYHPATFGQGTKVEIK |
| SEQ ID NO: 39 | SLT-1A-FR::scFv-7 | MKEFTLDFSTAKTYVDSLNVIRSAIGTPLQTISSGGT SLLMIDSGSGDNLFAVDVRGIDPEEGRFNNLRLIVER NNLYVTGFVNRTNNVFYRFADFSHVTFPGTTAVTL SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASAVAAE FPKPSTPPGSSGGAPDIVLTQSPASLAVSLGQRATISC RATESVEYYGTSLVQWYQQKPGQPPKLLIYAASSV DSGVPARFSGSGSGTDFSLTIHPVEEDDIAMYFCQQS RRVPYTFGGGTKLEIKGGGGSEVQLQQSGPELVKPG ASVKMSCKASGYTFTSYVNIHWVKQKPGQGLEWIG YVNPFNDGTKYNEMFKGKATLTSDKSSSTAYMELS SLTSEDSAVYYCARQAWGYPWGQGTLVTVSA |
| SEQ ID NO: 40 | SLT-1A-FR::scFv-8 | MKEFTLDFSTAKTYVDSLNVIRSAIGTPLQTISSGGT SLLMIDSGSGDNLFAVDVRGIDPEEGRFNNLRLIVER NNLYVTGFVNRTNNVFYRFADFSHVTFPGTTAVTL SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASAVAAE FPKPSTPPGSSGGAPDIQMTQTTSSLSASLGDRVTISC RASQDISNYLAWYQQKPDGTVKLLIYYTSILHSGVP SRFSGSGSGTDYSLTISNLEQEDFATYFCQQGNTLP WTFGCGTKLEIKGSTSGSGKPGSGEGSEVQLVESGG GLVKPGGSLKLSCAASGFAFSIYDMSWVRQTPEKC LEWVAYISSGGGTTYYPDTVKGRFTISRDNAKNTLY LQMSSLKSEDTAMYYCARHSGYGTHWGVLFAYW GQGTLVTVSA |
| SEQ ID NO: 41 | SLT-1A-FR::scFv-9 | MKEFTLDFSTAKTYVDSLNVIRSAIGTPLQTISSGGT SLLMIDSGSGDNLFAVDVRGIDPEEGRFNNLRLIVER NNLYVTGFVNRTNNVFYRFADFSHVTFPGTTAVTL SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASAVAAE FPKPSTPPGSSGGAPDIELTQSPSSFSVSLGDRVTITC KASEDIYNRLAWYQQKPGNAPRLLISGATSLETGVP |

-continued

Sequence Listing

| ID Number | Text Description | Biological Sequence |
|---|---|---|
| | | SRFSGSGSGKDYTLSITSLQTEDVATYYCQQYWSTP TFGGGTKLEIKGSTSGSGKPGSGEGSKVQLQESGPS LVQPSQRLSITCTVSGFSLISYGVHWVRQSPGKGLE WLGVIWRGGSTDYNAAFMSRLSITKDNSKSQVFFK MNSLQADDTAIYFCAKTLITTGYAMDYWGQGTTV TVSS |
| SEQ ID NO: 42 | SLT-1A-WT::scFv-9 | MKEFTLDFSTAKTYVDSLNVIRSAIGTPLQTISSGGT SLLMIDSGSGDNLFAVDVRGIDPEEGRFNNLRLIVER NNLYVTGFVNRTNNVFYRFADFSHVTFPGTTAVTL SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASRVARE FPKPSTPPGSSGGAPDIELTQSPSSFSVSLGDRVTITC KASEDIYNRLAWYQQKPGNAPRLLISGATSLETGVP SRFSGSGSGKDYTLSITSLQTEDVATYYCQQYWSTP TFGGGTKLEIKGSTSGSGKPGSGEGSKVQLQESGPS LVQPSQRLSITCTVSGFSLISYGVHWVRQSPGKGLE WLGVIWRGGSTDYNAAFMSRLSITKDNSKSQVFFK MNSLQADDTAIYFCAKTLITTGYAMDYWGQGTTV TVSS |
| SEQ ID NO: 43 | SLT-1A-combo1::scFv-1 | MKEFTLDFSTAKTYVDSLNVIRSAIGTPLQTISSGGT SLLMIDSGSGDNLFAVDILGFDFTLGRFNNLRLIVER NNLYVTGFVNRTNNVFYRFADFSHVTFPGTTAVTL SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASAVAAE FPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGGGGSQVQLQESGPGLVRPSQTLS LTCTVSGFSLTSYGVHWVRQPPGRGLEWIGVMWR GGSTDYNAAFMSRLNITKDNSKNQVSLRLSSVTAA DTAVYYCAKSMITTGFVMDSWGQGSLVTVSS |
| SEQ ID NO: 44 | SLT-1A-combo7::scFv-1 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGGGGSQVQLQESGPGLVRPSQTLS LTCTVSGFSLTSYGVHWVRQPPGRGLEWIGVMWR GGSTDYNAAFMSRLNITKDNSKNQVSLRLSSVTAA DTAVYYCAKSMITTGFVMDSWGQGSLVTVSS |
| SEQ ID NO: 45 | SLT-1A-combo8::scFv-1 | MKEFTLDFSTAKTYVDSLNVIRSAIGTPLQTISSGGT SLLMIDSGIGDNLFAVDILGFVFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGGGGSQVQLQESGPGLVRPSQTLS LTCTVSGFSLTSYGVHWVRQPPGRGLEWIGVMWR GGSTDYNAAFMSRLNITKDNSKNQVSLRLSSVTAA DTAVYYCAKSMITTGFVMDSWGQGSLVTVSS |
| SEQ ID NO: 46 | SLT-1A-combo9::scFv-1 | MKEFTLDFSTAKTYVDSLNVIRSAIGTPLQTISSGGT SLLMIDSGIGDNLFAVGILGFDFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA |

-continued

Sequence Listing

| ID Number | Text Description | Biological Sequence |
|---|---|---|
| | | EFPKPSTPPGSSGGAPDIQMTQSPSSLSASVGDRVTIT<br>CKASEDIYNRLTWYQQKPGKAPKLLISGATSLETGV<br>PSRFSGSGSGTDFTFTISSLQPEDIATYYCQQYWSNP<br>YTFGQGTKVEIKGGGGSQVQLQESGPGLVRPSQTLS<br>LTCTVSGFSLTSYGVHWVRQPPGRGLEWIGVMWR<br>GGSTDYNAAFMSRLNITKDNSKNQVSLRLSSVTAA<br>DTAVYYCAKSMITTGFVMDSWGQGSLVTVSS |
| SEQ ID NO: 47 | SLT-1A-<br>combo10::scFv-1 | MKEFTLDFSTAKTYVDSLNVIRSAIGTPLQTISSGGT<br>SLLMIDSGIGDNLFAVDILGFDFTLGRFNNLRLIVER<br>NNLYVTGFVNRTNNVFYRFADFSHVTFPGTTAVTL<br>SADSSYTTLQRVAGISRTGMQINRHSLTTSYLDLMS<br>HSATSLTQSVARAMLRFVTVTAEALRFRQIQRGFRT<br>TLDDLSGRSYVMTAEDVDLTLNWGRLSSVLPDYHG<br>QDSVRVGRISFGSINAILGSVALILNSHHHASAVAAE<br>FPKPSTPPGSSGGAPDIQMTQSPSSLSASVGDRVTIT<br>CKASEDIYNRLTWYQQKPGKAPKLLISGATSLETGV<br>PSRFSGSGSGTDFTFTISSLQPEDIATYYCQQYWSNP<br>YTFGQGTKVEIKGGGGSQVQLQESGPGLVRPSQTLS<br>LTCTVSGFSLTSYGVHWVRQPPGRGLEWIGVMWR<br>GGSTDYNAAFMSRLNITKDNSKNQVSLRLSSVTAA<br>DTAVYYCAKSMITTGFVMDSWGQGSLVTVSS |
| SEQ ID NO: 48 | SLT-1A-<br>combo11::scFv-1 | MKEFTLDFSTAKTYVDSLNVIRSAIGTPLQTISSGGT<br>SLLMIDSGIGDNLFAVGILGFVFTLGRFNNLRLIVER<br>NNLYVTGFVNRTNNVFYRFADFSHVTFPGTTAVTL<br>SADSSYTTLQRVAGISRTGMQINRHSLTTSYLDLMS<br>HSGTSLTQSVARAMLRFVTVTAEALRFRQIQRGFRT<br>TLDDLSGASYVMTAEDVDLTLNWGRLSSVLPDYH<br>GQDSVRVGRISFGSINAILGSVALILNSHHHASAVAA<br>EFPKPSTPPGSSGGAPDIQMTQSPSSLSASVGDRVTIT<br>CKASEDIYNRLTWYQQKPGKAPKLLISGATSLETGV<br>PSRFSGSGSGTDFTFTISSLQPEDIATYYCQQYWSNP<br>YTFGQGTKVEIKGGGGSQVQLQESGPGLVRPSQTLS<br>LTCTVSGFSLTSYGVHWVRQPPGRGLEWIGVMWR<br>GGSTDYNAAFMSRLNITKDNSKNQVSLRLSSVTAA<br>DTAVYYCAKSMITTGFVMDSWGQGSLVTVSS |
| SEQ ID NO: 49 | SLT-1A-<br>combo12::scFv-1 | MAEFTLDFSTAKTYVDSLNVIRSAIGTPLQTISSGGT<br>SLLMIDSGIGDNLFAVDILGFDFTLGRFNNLRLIVER<br>NNLYVTGFVNRTNNVFYRFADFSHVTFPGTTAVTL<br>SADSSYTTLQRVAGISRTGMQINRHSLTTSYLDLMS<br>HSATSLTQSVARAMLRFVTVTAEALRFRQIQRGFRT<br>TLDDLSGRSYVMTAEDVDLTLNWGRLSSVLPDYHG<br>QDSVRVGRISFGSINAILGSVALILNSHHHASAVAAE<br>FPKPSTPPGSSGGAPDIQMTQSPSSLSASVGDRVTIT<br>CKASEDIYNRLTWYQQKPGKAPKLLISGATSLETGV<br>PSRFSGSGSGTDFTFTISSLQPEDIATYYCQQYWSNP<br>YTFGQGTKVEIKGGGGSQVQLQESGPGLVRPSQTLS<br>LTCTVSGFSLTSYGVHWVRQPPGRGLEWIGVMWR<br>GGSTDYNAAFMSRLNITKDNSKNQVSLRLSSVTAA<br>DTAVYYCAKSMITTGFVMDSWGQGSLVTVSS |
| SEQ ID NO: 50 | SLT-1A-<br>combo14::scFv-1 | MKEFTLDFSTAKTYVDSLNVIRSAIGTPLQTISSGGT<br>SLLMIDSGIGDNLFAVDILGFDFTLGRFNNLRLIVER<br>NNLYVTGFVNRTNNVFYRFADFSHVTFPGTTAVTL<br>SADSSYTTLQRVAGISRTGMQINRHSLTTSYLDLMS<br>HSATSLTQSVARAMLRFVTVTAEALRFRQIQRGFRT<br>TLDDLSGASYVMTAEDVDLTLNWGRLSSVLPDYH<br>GQDSVRVGRISFGSINAILGSVALILNSHHHASAVAA<br>EFPKPSTPPGSSGGAPDIQMTQSPSSLSASVGDRVTIT<br>CKASEDIYNRLTWYQQKPGKAPKLLISGATSLETGV<br>PSRFSGSGSGTDFTFTISSLQPEDIATYYCQQYWSNP<br>YTFGQGTKVEIKGGGGSQVQLQESGPGLVRPSQTLS<br>LTCTVSGFSLTSYGVHWVRQPPGRGLEWIGVMWR<br>GGSTDYNAAFMSRLNITKDNSKNQVSLRLSSVTAA<br>DTAVYYCAKSMITTGFVMDSWGQGSLVTVSS |
| SEQ ID NO: 51 | SLT-1A-<br>combo15::scFv-1 | MAEFTLDFSTAKTYVDSLNVIRSAIGTPLQTISSGGT<br>SLLMIDSGIGDNLFAVDILGFDFTLGRFNNLRLIVER<br>NNLYVTGFVNRTNNVFYRFADFSHVTFPGTTAVTL<br>SADSSYTTLQRVAGISRTGMQINRHSLTTSYLDLMS<br>HSATSLTQSVARAMLRFVTVTAEALRFRQIQRGFRT<br>TLDDLSGASYVMTAEDVDLTLNWGRLSSVLPDYH |

-continued

Sequence Listing

| ID Number | Text Description | Biological Sequence |
|---|---|---|
| | | GQDSVRVGRISFGSINAILGSVALILNSHHHASAVAA EFPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGGGGSQVQLQESGPGLVRPSQTLS LTCTVSGFSLTSYGVHWVRQPPGRGLEWIGVMWR GGSTDYNAAFMSRLNITKDNSKNQVSLRLSSVTAA DTAVYYCAKSMITTGFVMDSWGQGSLVTVSS |
| SEQ ID NO: 52 | SLT-1A-combo16::scFv-1 | MKEFILDFSTAKTYVDSLNVIRSAIGTPLQTISSGGTS LLMIDSGIGDNLFAVDILGFDFTLGRFNNLRLIVERN NLYVTGFVNRTNNVFYRFADFSHVTFPGTTAVTLS ADSSYTTLQRVAGISRTGMQINRHSLTTSYLDLMSH SATSLTQSVARAMLRFVTVTAEALRFRQIQRGFRTT LDDLSGASYVMTAEDVDLTLNWGRLSSVLPDYHG QDSVRVGRISFGSINAILGSVALILNSHHHASAVAAE FPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGGGGSQVQLQESGPGLVRPSQTLS LTCTVSGFSLTSYGVHWVRQPPGRGLEWIGVMWR GGSTDYNAAFMSRLNITKDNSKNQVSLRLSSVTAA DTAVYYCAKSMITTGFVMDSWGQGSLVTVSS |
| SEQ ID NO: 53 | SLT-1A-combo17::scFv-1 | MAEFILDFSTAKTYVDSLNVIRSAIGTPLQTISSGGTS LLMIDSGIGDNLFAVDILGFDFTLGRFNNLRLIVERN NLYVTGFVNRTNNVFYRFADFSHVTFPGTTAVTLS ADSSYTTLQRVAGISRTGMQINRHSLTTSYLDLMSH SATSLTQSVARAMLRFVTVTAEALRFRQIQRGFRTT LDDLSGASYVMTAEDVDLTLNWGRLSSVLPDYHG QDSVRVGRISFGSINAILGSVALILNSHHHASAVAAE FPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGGGGSQVQLQESGPGLVRPSQTLS LTCTVSGFSLTSYGVHWVRQPPGRGLEWIGVMWR GGSTDYNAAFMSRLNITKDNSKNQVSLRLSSVTAA DTAVYYCAKSMITTGFVMDSWGQGSLVTVSS |
| SEQ ID NO: 54 | SLT-1A-combo18::scFv-1 | MAEFILDFSTAKTYVDSLNVIRSAIGTPLQTISSGGTS LLMIDSGIGDNLFAVNLVPMVATVGRFNNLRLIVER NNLYVTGFVNRTNNVFYRFADFSHVTFPGTTAVTL SADSSYTTLQRVAGISRTGMQINRHSLTTSYLDLMS HSATSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGGGGSQVQLQESGPGLVRPSQTLS LTCTVSGFSLTSYGVHWVRQPPGRGLEWIGVMWR GGSTDYNAAFMSRLNITKDNSKNQVSLRLSSVTAA DTAVYYCAKSMITTGFVMDSWGQGSLVTVSS |
| SEQ ID NO: 55 | SLT-1A-combo19::scFv-1 | MKEFILDFSTAKTYVDSLNVIRSAIGTPLQTISSGGTS LLMIDSGIGDNLFAVDVRGIAPIEARFNNLRLIVERN NLYVTGFVNRTNNVFYRFADFSHVTFPGTTAVTLS ADSSYTTLQRVAGISRTGMQINRHSLTTSYLDLMSH SATSLTQSVARAMLRFVTVTAEALRFRQIQRGFRTT LAALSGASYVMTAEDVDLTLNWGRLSSVLPDYHG QDSVRVGRISFGSINAILGSVALILNSHHHASAVAAE FPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGGGGSQVQLQESGPGLVRPSQTLS LTCTVSGFSLTSYGVHWVRQPPGRGLEWIGVMWR GGSTDYNAAFMSRLNITKDNSKNQVSLRLSSVTAA DTAVYYCAKSMITTGFVMDSWGQGSLVTVSS |
| SEQ ID NO: 56 | SLT-1A-combo20::scFv-1 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SADSSYTTLQRVAGISRTGMQINRHSLTTSYLDLMS HSATSLTQSVARAMLRFVTVTAEALRFRQIQRGFRT TLDDLSGRSYVMTAEDVDLTLNWGRLSSVLPDYHG |

-continued

Sequence Listing

| ID Number | Text Description | Biological Sequence |
|---|---|---|
| | | QDSVRVGRISFGSINAILGSVALILNSHHHARNLVPM VATVASAVAAEFPKPSTPPGSSGGAPDIQMTQSPSSL SASVGDRVTITCKASEDIYNRLTWYQQKPGKAPKL LISGATSLETGVPSRFSGSGSGTDFTFTISSLQPEDIAT YYCQQYWSNPYTFGQGTKVEIKGGGGSQVQLQES GPGLVRPSQTLSLTCTVSGFSLTSYGVHWVRQPPGR GLEWIGVMWRGGSTDYNAAFMSRLNITKDNSKNQ VSLRLSSVTAADTAVYYCAKSMITTGFVMDSWGQ GSLVTVSS |
| SEQ ID NO: 57 | SLT-1A-combo0::scFv-2 | MKEFTLDFSTAKTYVDSLNVIRSAIGTPLQTISSGGT SLLMIDSGSGDNLFAVDVRGIDPEEGRFNNLRLIVER NNLYVTGFVNRTNNVFYRFADFSHVTFPGTNLVPM VATVSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASAVAAE FPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGSTSGSGKPGSGEGSTKGQVQLQE SGPGLVRPSQTLSLTCTVSGFSLTSYGVHWVRQPPG RGLEWIGVMWRGGSTDYNAAFMSRLNITKDNSKN QVSLRLSSVTAADTAVYYCAKSMITTGFVMDSWG QGSLVTVSSA |
| SEQ ID NO: 58 | SLT-1A-combo2::scFv-2 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNSHHHASAVAAE FPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGSTSGSGKPGSGEGSTKGQVQLQE SGPGLVRPSQTLSLTCTVSGFSLTSYGVHWVRQPPG RGLEWIGVMWRGGSTDYNAAFMSRLNITKDNSKN QVSLRLSSVTAADTAVYYCAKSMITTGFVMDSWG QGSLVTVSS |
| SEQ ID NO: 59 | SLT-1A-combo3::scFv-2 | MKEFTLDFSTAKTYVDSLNVIRSAIGTPLQTISSGGT SLLMIDSGSGDNLFAVNLVPMVATVGRFNNLRLIVE RNNLYVTGFVNRTNNVFYRFADFSHVTFPGTTAVT LSGDSSYTTLQRVAGISRTGMQINRHSLTTSYLDLM SHSGTSLTQSVARAMLRFVTVTAEALRFRQIQRGFR TTLDDLSGRSYVMTAEDVDLTLNWGRLSSVLPDYH GQDSVRVGRISFGSINAILGSVALILNCHHHASAVA AEFPKPSTPPGSSGGAPDIQMTQSPSSLSASVGDRVT ITCKASEDIYNRLTWYQQKPGKAPKLLISGATSLET GVPSRFSGSGSGTDFTFTISSLQPEDIATYYCQQYWS NPYTFGQGTKVEIKGSTSGSGKPGSGEGSTKGQVQL QESGPGLVRPSQTLSLTCTVSGFSLTSYGVHWVRQP PGRGLEWIGVMWRGGSTDYNAAFMSRLNITKDNS KNQVSLRLSSVTAADTAVYYCAKSMITTGFVMDS WGQGSLVTVSSA |
| SEQ ID NO: 60 | SLT-1A-combo4::scFv-2 | MKEFTLDFSTAKTYVDSLNVIRSAIGTPLQTISSGGT SLLMIDNLVPMVATVVDVRGIDPEEGRFNNLRLIVE RNNLYVTGFVNRTNNVFYRFADFSHVTFPGTTAVT LSGDSSYTTLQRVAGISRTGMQINRHSLTTSYLDLM SHSGTSLTQSVARAMLRFVTVTAEALRFRQIQRGFR TTLDDLSGRSYVMTAEDVDLTLNWGRLSSVLPDYH GQDSVRVGRISFGSINAILGSVALILNCHHHASAVA AEFPKPSTPPGSSGGAPDIQMTQSPSSLSASVGDRVT ITCKASEDIYNRLTWYQQKPGKAPKLLISGATSLET GVPSRFSGSGSGTDFTFTISSLQPEDIATYYCQQYWS NPYTFGQGTKVEIKGSTSGSGKPGSGEGSTKGQVQL QESGPGLVRPSQTLSLTCTVSGFSLTSYGVHWVRQP PGRGLEWIGVMWRGGSTDYNAAFMSRLNITKDNS KNQVSLRLSSVTAADTAVYYCAKSMITTGFVMDS WGQGSLVTVSSA |

-continued

Sequence Listing

| ID Number | Text Description | Biological Sequence |
|---|---|---|
| SEQ ID NO: 61 | SLT-1A-combo10::scFv-2 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SADSSYTTLQRVAGISRTGMQINRHSLTTSYLDLMS HSATSLTQSVARAMLRFVTVTAEALRFRQIQRGFRT TLDDLSGRSYVMTAEDVDLTLNWGRLSSVLPDYHG QDSVRVGRISFGSINAILGSVALILNSHHHASAVAAE FPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGSTSGSGKPGSGEGSTKGQVQLQE SGPGLVRPSQTLSLTCTVSGFSLTSYGVHWVRQPPG RGLEWIGVMWRGGSTDYNAAFMSRLNITKDNSKN QVSLRLSSVTAADTAVYYCAKSMITTGFVMDSWG QGSLVTVSSA |
| SEQ ID NO: 62 | SLT-1A-combo13::scFv-2 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SGDSSYTTLQRVAGISRTGMQINRHSLTTSYLDLMS HSGTSLTQSVARAMLRFVTVTAEALRFRQIQRGFRG ILGDVFTRSYVMTAEDVDLTLNWGRLSSVLPDYHG QDSVRVGRISFGSINAILGSVALILNSHHHASAVAAE FPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGSTSGSGKPGSGEGSTKGQVQLQE SGPGLVRPSQTLSLTCTVSGFSLTSYGVHWVRQPPG RGLEWIGVMWRGGSTDYNAAFMSRLNITKDNSKN QVSLRLSSVTAADTAVYYCAKSMITTGFVMDSWG QGSLVTVSS |
| SEQ ID NO: 63 | SLT-1A-combo22::scFv-2 | MKEFTLDFSTAKTYVDSLNVIRSAIGTPLQTISSGGT SLLMIDSGSGDNLFAVDVRGIAPEEGRFNNLRLIVER NNLYVTGFVNRTNNVFYRFADFSHVTFPGTTAVTL SADSSYTTLQRVAGISRTGMQINRHSLTTSYLDLMS HSATSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGSTSGSGKPGSGEGSTKGQVQLQE SGPGLVRPSQTLSLTCTVSGFSLTSYGVHWVRQPPG RGLEWIGVMWRGGSTDYNAAFMSRLNITKDNSKN QVSLRLSSVTAADTAVYYCAKSMITTGFVMDSWG QGSLVTVSSA |
| SEQ ID NO: 64 | scFv-3:: SLT-1A-combo5 | MQVQLQQPGAELVKPGASVKMSCKTSGYTFTSYN VHWVKQTPGQGLEWIGAIYPGNGDTSFNQKFKGK ATLTADKSSSTVYMQLSSLTSEDSAVYYCARSNYY GSSYVWFFDVWGAGTTVTVSSGSTSGSGKPGSGEG SQIVLSQSPTILSASPGEKVTMTCRASSSVSYMDWY QQKPGSSPKPWIYATSNLASGVPARFSGSGSGTSYS LTISRVEAEDAATYYCQQWISNPPTFGAGTKLELKE FPKPSTPPGSSGGAPKEFTLDFSTAKTYVDSLNVIRS AIGTPLQTISSGGTSLLMIDSGIGDNLFAVDILGFDFT LGRFNNLRLIVERNNLYVTGFVNRTNNVFYRFADFS HVTFPGTTAVTLSADSSYTTLQRVAGISRTGMQINR HSLTTSYLDLMSHSGTSLTQSVARAMLRFVTVTAE ALRFRQIQRGFRTTLDDLSGASYVMTAEDVDLTLN WGRLSSVLPDYHGQDSVRVGRISFGSINAILGSVALI LNCHHHASRVAR |
| SEQ ID NO: 65 | scFv-3:: SLT-1A-combo6 | MQVQLQQPGAELVKPGASVKMSCKTSGYTFTSYN VHWVKQTPGQGLEWIGAIYPGNGDTSFNQKFKGK ATLTADKSSSTVYMQLSSLTSEDSAVYYCARSNYY GSSYVWFFDVWGAGTTVTVSSGSTSGSGKPGSGEG SQIVLSQSPTILSASPGEKVTMTCRASSSVSYMDWY QQKPGSSPKPWIYATSNLASGVPARFSGSGSGTSYS LTISRVEAEDAATYYCQQWISNPPTFGAGTKLELKE FPKPSTPPGSSGGAPKEFTLDFSTAKTYVDSLNVIRS AIGTPLQTISSGGTSLLMIDSGIGDNLFAVDILGFDFT LGRFNNLRLIVERNNLYVTGFVNRTNNVFYRFADFS HVTFPGTTAVTLSADSSYTTLQRVAGISRTGMQINR |

-continued

Sequence Listing

| ID Number | Text Description | Biological Sequence |
|---|---|---|
| | | HSLTTSYLDLMSHSATSLTQSVARAMLRFVTVTAE ALRFRQIQRGFRTTLDDLSGASYVMTAEDVDLTLN WGRLSSVLPDYHGQDSVRVGRISFGSINAILGSVALI LNCHHHASRVAR |
| SEQ ID NO: 66 | SLT-1A-combo7::scFv-4 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPDIQMTQSPSSLSASVGDRVTIT CRASQDVNTAVAWYQQKPGKAPKLLIYSASFLYSG VPSRFSGSRSGTDFTLTISSLQPEDFATYYCQQHYTT PPTFGQGTKVEIKGGGGSGGGGSGGGGSGGGGSGG GGSEVQLVESGGGLVQPGGSLRLSCAASGFNIKDTY IHWVRQAPGKGLEWVARIYPTNGYTRYADSVKGRF TISADTSKNTAYLQMNSLRAEDTAVYYCSRWGGD GFYAMDYWGQGTLVTVSS |
| SEQ ID NO: 67 | SLT-1A-combo14::scFv-4 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SADSSYTTLQRVAGISRTGMQINRHSLTTSYLDLMS HSATSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPDIQMTQSPSSLSASVGDRVTIT CRASQDVNTAVAWYQQKPGKAPKLLIYSASFLYSG VPSRFSGSRSGTDFTLTISSLQPEDFATYYCQQHYTT PPTFGQGTKVEIKGGGGSGGGGSGGGGSGGGGSGG GGSEVQLVESGGGLVQPGGSLRLSCAASGFNIKDTY IHWVRQAPGKGLEWVARIYPTNGYTRYADSVKGRF TISADTSKNTAYLQMNSLRAEDTAVYYCSRWGGD GFYAMDYWGQGTLVTVSS |
| SEQ ID NO: 68 | SLT-1A-combo7::scFv-5 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPDIQMTQSPSSLSASVGDRVTIT CRASQGISSWLAWYQQKPEKAPKSLIYAASSLQSGV PSRFSGSGSGTDFTLTISSLQPEDFATYYCQQYNSYP YTFGQGTKLEIKGGGGSQVQLVQSGAEVKKPGASV KVSCKASGYTFTSYDVHWVRQAPGQRLEWMGWL HADTGITKFSQKFQGRVTITRDTSASTAYMELSSLRS EDTAVYYCARERIQLWFDYWGQGTLVTVSS |
| SEQ ID NO: 69 | SLT-1A-combo8::scFv-5 | MKEFTLDFSTAKTYVDSLNVIRSAIGTPLQTISSGGT SLLMIDSGIGDNLFAVDILGFVFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPDIQMTQSPSSLSASVGDRVTIT CRASQGISSWLAWYQQKPEKAPKSLIYAASSLQSGV PSRFSGSGSGTDFTLTISSLQPEDFATYYCQQYNSYP YTFGQGTKLEIKGGGGSQVQLVQSGAEVKKPGASV KVSCKASGYTFTSYDVHWVRQAPGQRLEWMGWL HADTGITKFSQKFQGRVTITRDTSASTAYMELSSLRS EDTAVYYCARERIQLWFDYWGQGTLVTVSS |
| SEQ ID NO: 70 | SLT-1A-combo9::scFv-5 | MKEFTLDFSTAKTYVDSLNVIRSAIGTPLQTISSGGT SLLMIDSGIGDNLFAVGILGFDFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPDIQMTQSPSSLSASVGDRVTIT |

-continued

Sequence Listing

| ID Number | Text Description | Biological Sequence |
|---|---|---|
| | | CRASQGISSWLAWYQQKPEKAPKSLIYAASSLQSGV PSRFSGSGSGTDFTLTISSLQPEDFATYYCQQYNSYP YTFGQGTKLEIKGGGGSQVQLVQSGAEVKKPGASV KVSCKASGYTFTSYDVHWVRQAPGQRLEWMGWL HADTGITKFSQKFQGRVTITRDTSASTAYMELSSLRS EDTAVYYCARERIQLWFDYWGQGTLVTVSS |
| SEQ ID NO: 71 | SLT-1A-combo11::scFv-5 | MKEFTLDFSTAKTYVDSLNVIRSAIGTPLQTISSGGT SLLMIDSGIGDNLFAVGILGFVFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPDIQMTQSPSSLSASVGDRVTIT CRASQGISSWLAWYQQKPEKAPKSLIYAASSLQSGV PSRFSGSGSGTDFTLTISSLQPEDFATYYCQQYNSYP YTFGQGTKLEIKGGGGSQVQLVQSGAEVKKPGASV KVSCKASGYTFTSYDVHWVRQAPGQRLEWMGWL HADTGITKFSQKFQGRVTITRDTSASTAYMELSSLRS EDTAVYYCARERIQLWFDYWGQGTLVTVSS |
| SEQ ID NO: 72 | SLT-1A-combo7::scFv-6 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPEVQLVESGGGLVQPGGSLRLS CAASGFTFSDSWIHWVRQAPGKGLEWVAWISPYGG STYYADSVKGRFTISADTSKNTAYLQMNSLRAEDT AVYYCARRHWPGGFDYWGQGTLVTVSSGGGGSDI QMTQSPSSLSASVGDRVTITCRASQDVSTAVAWYQ QKPGKAPKLLIYSASFLYSGVPSRFSGSGSGTDFTLT ISSLQPEDFATYYCQQYLYHPATFGQGTKVEIK |
| SEQ ID NO: 73 | SLT-1A-combo8::scFv-6 | MKEFTLDFSTAKTYVDSLNVIRSAIGTPLQTISSGGT SLLMIDSGIGDNLFAVDILGFVFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPEVQLVESGGGLVQPGGSLRLS CAASGFTFSDSWIHWVRQAPGKGLEWVAWISPYGG STYYADSVKGRFTISADTSKNTAYLQMNSLRAEDT AVYYCARRHWPGGFDYWGQGTLVTVSSGGGGSDI QMTQSPSSLSASVGDRVTITCRASQDVSTAVAWYQ QKPGKAPKLLIYSASFLYSGVPSRFSGSGSGTDFTLT ISSLQPEDFATYYCQQYLYHPATFGQGTKVEIK |
| SEQ ID NO: 74 | SLT-1A-combo9::scFv-6 | MKEFTLDFSTAKTYVDSLNVIRSAIGTPLQTISSGGT SLLMIDSGIGDNLFAVGILGFDFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPEVQLVESGGGLVQPGGSLRLS CAASGFTFSDSWIHWVRQAPGKGLEWVAWISPYGG STYYADSVKGRFTISADTSKNTAYLQMNSLRAEDT AVYYCARRHWPGGFDYWGQGTLVTVSSGGGGSDI QMTQSPSSLSASVGDRVTITCRASQDVSTAVAWYQ QKPGKAPKLLIYSASFLYSGVPSRFSGSGSGTDFTLT ISSLQPEDFATYYCQQYLYHPATFGQGTKVEIK |
| SEQ ID NO: 75 | SLT-1A-combo21::scFv-6 | MKEFTLDFSTAKTYVDSLNVIRSAIGTPLQTISSGGT SLLMIDSGIGDNLFAVDILGFDFTLGRFNNLRLIVER NNLYVTGFVNATNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPEVQLVESGGGLVQPGGSLRLS |

-continued

Sequence Listing

| ID Number | Text Description | Biological Sequence |
|---|---|---|
| | | CAASGFTFSDSWIHWVRQAPGKGLEWVAWISPYGG STYYADSVKGRFTISADTSKNTAYLQMNSLRAEDT AVYYCARRHWPGGFDYWGQGTLVTVSSGGGGSDI QMTQSPSSLSASVGDRVTITCRASQDVSTAVAWYQ QKPGKAPKLLIYSASFLYSGVPSRFSGSGSGTDFTLT ISSLQPEDFATYYCQQYLYHPATFGQGTKVEIK |
| SEQ ID NO: 76 | SLT-1A-combo23::scFv-6 | MKEFTLDFSTAKTYVDSLNVIRSAIGTPLQTISSGGT SLLMIDSGIGDNLFAVDILGFDFTLGRFNNLRLIVER NNLYVTGFVNRTNNAFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPEVQLVESGGGLVQPGGSLRLS CAASGFTFSDSWIHWVRQAPGKGLEWVAWISPYGG STYYADSVKGRFTISADTSKNTAYLQMNSLRAEDT AVYYCARRHWPGGFDYWGQGTLVTVSSGGGGSDI QMTQSPSSLSASVGDRVTITCRASQDVSTAVAWYQ QKPGKAPKLLIYSASFLYSGVPSRFSGSGSGTDFTLT ISSLQPEDFATYYCQQYLYHPATFGQGTKVEIK |
| SEQ ID NO: 77 | SLT-1A-combo24::scFv-6 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSAARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPEVQLVESGGGLVQPGGSLRLS CAASGFTFSDSWIHWVRQAPGKGLEWVAWISPYGG STYYADSVKGRFTISADTSKNTAYLQMNSLRAEDT AVYYCARRHWPGGFDYWGQGTLVTVSSGGGGSDI QMTQSPSSLSASVGDRVTITCRASQDVSTAVAWYQ QKPGKAPKLLIYSASFLYSGVPSRFSGSGSGTDFTLT ISSLQPEDFATYYCQQYLYHPATFGQGTKVEIK |
| SEQ ID NO: 78 | SLT-1A-combo25::scFv-6 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SADSSYTTLQRVAGISRTGMQINRHSLTTSYLALMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPEVQLVESGGGLVQPGGSLRLS CAASGFTFSDSWIHWVRQAPGKGLEWVAWISPYGG STYYADSVKGRFTISADTSKNTAYLQMNSLRAEDT AVYYCARRHWPGGFDYWGQGTLVTVSSGGGGSDI QMTQSPSSLSASVGDRVTITCRASQDVSTAVAWYQ QKPGKAPKLLIYSASFLYSGVPSRFSGSGSGTDFTLT ISSLQPEDFATYYCQQYLYHPATFGQGTKVEIK |
| SEQ ID NO: 79 | SLT-1A-combo26::scFv-6 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVALTLNWGRLSSVLPDYH GQDSVRVGRISFGSINAILGSVALILNSHHHASAVAA EFPKPSTPPGSSGGAPEVQLVESGGGLVQPGGSLRLS CAASGFTFSDSWIHWVRQAPGKGLEWVAWISPYGG STYYADSVKGRFTISADTSKNTAYLQMNSLRAEDT AVYYCARRHWPGGFDYWGQGTLVTVSSGGGGSDI QMTQSPSSLSASVGDRVTITCRASQDVSTAVAWYQ QKPGKAPKLLIYSASFLYSGVPSRFSGSGSGTDFTLT ISSLQPEDFATYYCQQYLYHPATFGQGTKVEIK |
| SEQ ID NO: 80 | SLT-1A-combo0::scFv-8 | MKEFTLDFSTAKTYVDSLNVIRSAIGTPLQTISSGGT SLLMIDSGSGDNLFAVDVRGIDPEEGRFNNLRLIVER NNLYVTGFVNRTNNVFYRFADFSHVTFPGTNLVPM VATVSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASAVAAE FPKPSTPPGSSGGAPDIQMTQTTSSLSASLGDRVTISC |

-continued

| Sequence Listing | | |
|---|---|---|
| ID Number | Text Description | Biological Sequence |
| | | RASQDISNYLAWYQQKPDGTVKLLIYYTSILHSGVP SRFSGSGSGTDYSLTISNLEQEDFATYFCQQGNTLP WTFGCGTKLEIKGSTSGSGKPGSGEGSEVQLVESGG GLVKPGGSLKLSCAASGFAFSIYDMSWVRQTPEKC LEWVAYISSGGGTTYYPDTVKGRFTISRDNAKNTLY LQMSSLKSEDTAMYYCARHSGYGTHWGVLFAYW GQGTLVTVSA |
| SEQ ID NO: 81 | SLT-1A-combo7::scFv-7 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPDIVLTQSPASLAVSLGQRATIS CRATESVEYYGTSLVQWYQQKPGQPPKLLIYAASS VDSGVPARFSGSGSGTDFSLTIHPVEEDDIAMYFCQ QSRRVPYTFGGGTKLEIKGGGGSEVQLQQSGPELVK PGASVKMSCKASGYTFTSYVMHWVKQKPGQGLE WIGYVNPFNDGTKYNEMFKGKATLTSDKSSSTAYM ELSSLTSEDSAVYYCARQAWGYPWGQGTLVTVSA |
| SEQ ID NO: 82 | SLT-1A-combo7::aCD38-scFv-1 | MKEFTLDFSTAKTYVDSLNVIRSAIGTPLQTISSGGT SLLMIDSGIGDNLFAVDILGFDFTLGRFNNLRLIVER NNLYVTGFVNRTNNVFYRFADFSHVTFPGTTAVTL SADSSYTTLQRVAGISRTGMQINRHSLTTSYLDLMS HSGTSLTQSVARAMLRFVTVTAEALRFRQIQRGFRT TLDDLSGASYVMTAEDVDLTLNWGRLSSVLPDYH GQDSVRVGRISFGSINAILGSVALILNSHHHASAVAA EFPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGGGGSQVQLQESGPGLVRPSQTLS LTCTVSGFSLTSYGVHWVRQPPGRGLEWIGVMWR GGSTDYNAAFMSRLNITKDNSKNQVSLRLSSVTAA DTAVYYCAKSMITTGFVMDSWGQGSLVTVSS |
| SEQ ID NO: 83 | heavy chain ABR1 | YTFTSYVMH |
| SEQ ID NO: 84 | heavy chain ABR2 | WIGYINPYNDGTKY |
| SEQ ID NO: 85 | heavy chain ABR3 | RGTYYYGSRVFDY |
| SEQ ID NO: 86 | light chain ABR1 | KSLLNSNGNTYLY |
| SEQ ID NO: 87 | light chain ABR2 | LLIYRMSNLAS |
| SEQ ID NO: 88 | light chain ABR3 | MQHLEYPF |
| SEQ ID NO: 89 | heavy chain ABR1 | YAFSSYWMN |
| SEQ ID NO: 90 | heavy chain ABR2 | WIGQIWPGDGDTNY |
| SEQ ID NO: 91 | heavy chain ABR3 | RRETTTVGRYYYAMDY |
| SEQ ID NO: 92 | light chain ABR1 | QSVDYDGDSYLN |
| SEQ ID NO: 93 | light chain ABR2 | LLIYDASNLVS |
| SEQ ID NO: 94 | light chain ABR3 | QQSTEDPW |
| SEQ ID NO: 95 | heavy chain ABR2 | WIGQIWPGDGDTNYNG |
| SEQ ID NO: 96 | heavy chain ABR1 | GSISTSGMGVG |
| SEQ ID NO: 97 | heavy chain ABR2 | WIGHIWWDDDKRY |
| SEQ ID NO: 98 | heavy chain ABR3 | RMELWSYYFDY |
| SEQ ID NO: 99 | light chain ABR1 | SSVSYMH |
| SEQ ID NO: 100 | light chain ABR2 | LLIYDTSKLAS |
| SEQ ID NO: 101 | light chain ABR3 | FQGSVYPF |

-continued

Sequence Listing

| ID Number | Text Description | Biological Sequence |
|---|---|---|
| SEQ ID NO: 102 | heavy chain CDR1 | GYTFTSYNMH |
| SEQ ID NO: 103 | heavy chain CDR2 | AIYPGNGDTSYNQKFKG |
| SEQ ID NO: 104 | heavy chain CDR3 | AQLRPNYWYFDV |
| SEQ ID NO: 105 | light chain CDR1 | RASSSVSYMH |
| SEQ ID NO: 106 | light chain CDR2 | ATSNLAS |
| SEQ ID NO: 107 | light chain CDR3 | QQWISNPPT |
| SEQ ID NO: 108 | heavy chain CDR1 | GYTFTSYNVH |
| SEQ ID NO: 109 | heavy chain CDR3 | SNYYGSSYVWFFDV |
| SEQ ID NO: 110 | light chain CDR1 | RASSSVSYMD |
| SEQ ID NO: 111 | heavy chain CDR3 | STYYGGDWYFNV |
| SEQ ID NO: 112 | light chain CDR1 | RASSSVSYIH |
| SEQ ID NO: 113 | light chain CDR3 | QQWTSNPPT |
| SEQ ID NO: 114 | heavy chain CDR1 | GFTFNDYAMH |
| SEQ ID NO: 115 | heavy chain CDR2 | TISWNSGSIGYADSVKG |
| SEQ ID NO: 116 | heavy chain CDR3 | DIQYGNYYYGMDV |
| SEQ ID NO: 117 | light chain CDR1 | RASQSVSSYLA |
| SEQ ID NO: 118 | light chain CDR2 | DASNRAT |
| SEQ ID NO: 119 | light chain CDR3 | QQRSNWPIT |
| SEQ ID NO: 120 | heavy chain CDR1 | GYTFTSYNMH |
| SEQ ID NO: 121 | heavy chain CDR3 | VVYYSNSYWYFDV |
| SEQ ID NO: 122 | light chain CDR2 | APSNLAS |
| SEQ ID NO: 123 | light chain CDR3 | QQWSFNPPT |
| SEQ ID NO: 124 | heavy chain CDR1 | GYAFSYSWIN |
| SEQ ID NO: 125 | heavy chain CDR2 | RIFPGDGDTDYNGKFKG |
| SEQ ID NO: 126 | heavy chain CDR3 | NVFDGYWLVY |
| SEQ ID NO: 127 | light chain CDR1 | RSSKSLLHSNGITYLY |
| SEQ ID NO: 128 | light chain CDR2 | QMSNLVS |
| SEQ ID NO: 129 | light chain CDR3 | AQNLELPYT |
| SEQ ID NO: 130 | heavy chain ABR1 | YRFTNYWIH |
| SEQ ID NO: 131 | heavy chain ABR2 | WIGGINPGNNYATYRR |
| SEQ ID NO: 132 | heavy chain ABR3 | TREGYGNYGAWFAY |
| SEQ ID NO: 133 | light chain ABR1 | QSLANSYGNTFLS |
| SEQ ID NO: 134 | light chain ABR2 | LLIYGISNRFS |
| SEQ ID NO: 135 | light chain ABR3 | LQGTHQPY |
| SEQ ID NO: 136 | heavy chain ABR1 | FAFSIYDMS |
| SEQ ID NO: 137 | heavy chain ABR2 | WVAYISSGGGTTYY |
| SEQ ID NO: 138 | heavy chain ABR3 | RHSGYGTHWGVLFAY |
| SEQ ID NO: 139 | light chain ABR1 | QDISNYLA |

-continued

| Sequence Listing | | |
|---|---|---|
| ID Number | Text Description | Biological Sequence |
| SEQ ID NO: 140 | light chain ABR2 | LLIYYTSILHS |
| SEQ ID NO: 141 | light chain ABR3 | QQGNTLPW |
| SEQ ID NO: 142 | heavy chain ABR1 | YTFTSYWLH |
| SEQ ID NO: 143 | heavy chain ABR2 | WIGYINPRNDYTEY |
| SEQ ID NO: 144 | heavy chain ABR3 | RRDITTFY |
| SEQ ID NO: 145 | light chain ABR1 | QSVLYSANHKNYLA |
| SEQ ID NO: 146 | light chain ABR2 | LLIYWASTRES |
| SEQ ID NO: 147 | light chain ABR3 | HQYLSSW |
| SEQ ID NO: 148 | heavy chain ABR1 | YEFSRSWMN |
| SEQ ID NO: 149 | heavy chain ABR2 | WVGRIYPGDGDTNYSGKF |
| SEQ ID NO: 150 | heavy chain ABR3 | RDGSSWDWYFDV |
| SEQ ID NO: 151 | light chain ABR1 | QSIVHSVGNTFLE |
| SEQ ID NO: 152 | light chain ABR2 | LLIYKVSNRFS |
| SEQ ID NO: 153 | light chain ABR3 | FQGSQFPY |
| SEQ ID NO: 154 | heavy chain CDR1 | GYRFTNYWIH |
| SEQ ID NO: 155 | heavy chain CDR2 | GINPGNNYATYRRKFQG |
| SEQ ID NO: 156 | heavy chain CDR3 | EGYGNYGAWFAY |
| SEQ ID NO: 157 | light chain CDR1 | RSSQSLANSYGNTFLS |
| SEQ ID NO: 158 | light chain CDR2 | GISNRFS |
| SEQ ID NO: 159 | light chain CDR3 | LQGTHQPYT |
| SEQ ID NO: 160 | heavy chain CDR1 | GFAFSIYDMS |
| SEQ ID NO: 161 | heavy chain CDR2 | YISSGGGTTYYPDTVKG |
| SEQ ID NO: 162 | heavy chain CDR3 | HSGYGTHWGVLFAY |
| SEQ ID NO: 163 | light chain CDR1 | RASQDISNYLA |
| SEQ ID NO: 164 | light chain CDR2 | YTSILHS |
| SEQ ID NO: 165 | light chain CDR3 | QQGNTLPWT |
| SEQ ID NO: 166 | heavy chain CDR1 | GYTFTDYYIT |
| SEQ ID NO: 167 | heavy chain CDR2 | WIYPGSGNTKYNEKF |
| SEQ ID NO: 168 | heavy chain CDR3 | YGNYWFAY |
| SEQ ID NO: 169 | light chain CDR1 | KASQSVDFDGDSYMN |
| SEQ ID NO: 170 | light chain CDR2 | AASNLES |
| SEQ ID NO: 171 | light chain CDR3 | QQSNEDPWT |
| SEQ ID NO: 172 | heavy chain CDR1 | YTFTTYWMH |
| SEQ ID NO: 173 | heavy chain CDR2 | WIGYINPSTGYTDY |
| SEQ ID NO: 174 | heavy chain CDR3 | TRRGPSYGNHGAWFPY |
| SEQ ID NO: 175 | light chain CDR1 | ENVDTYVS |
| SEQ ID NO: 176 | light chain CDR2 | LLIYGASNRYT |
| SEQ ID NO: 177 | light chain CDR3 | GQSYRYPP |

-continued

| Sequence Listing | | |
|---|---|---|
| ID Number | Text Description | Biological Sequence |
| SEQ ID NO: 178 | heavy chain CDR1 | GYTFTGYYMH |
| SEQ ID NO: 179 | heavy chain CDR2 | WIDPNSGATTYAQKF |
| SEQ ID NO: 180 | heavy chain CDR3 | KTTQTTWGFPF |
| SEQ ID NO: 181 | light chain CDR1 | RASQGVYQWLA |
| SEQ ID NO: 182 | light chain CDR2 | KASHLYN |
| SEQ ID NO: 183 | light chain CDR3 | QQLNSYPLT |
| SEQ ID NO: 184 | heavy chain CDR1 | GYTFTDYWMH |
| SEQ ID NO: 185 | heavy chain CDR2 | WIGYINPNTAYTDY |
| SEQ ID NO: 186 | light chain CDR1 | KASENVDSFVS |
| SEQ ID NO: 187 | light chain CDR2 | GASNRYT |
| SEQ ID NO: 188 | light chain CDR3 | GQNYRYPLT |
| SEQ ID NO: 189 | heavy chain ABR1 | FSLISYGVH |
| SEQ ID NO: 190 | heavy chain ABR2 | WLGVIWRGGSTDY |
| SEQ ID NO: 191 | heavy chain ABR3 | KTLITTGYAMDY |
| SEQ ID NO: 192 | light chain ABR1 | EDIYNRLA |
| SEQ ID NO: 193 | light chain ABR2 | LLISGATSLETG |
| SEQ ID NO: 194 | light chain ABR3 | QQYWSTP |
| SEQ ID NO: 195 | heavy chain ABR1 | FTFNSFAMS |
| SEQ ID NO: 196 | heavy chain ABR2 | WVSAISGSGGGTYY |
| SEQ ID NO: 197 | heavy chain ABR3 | KDKILWFGEPVFDY |
| SEQ ID NO: 198 | light chain ABR1 | QSVSSYLA |
| SEQ ID NO: 199 | light chain ABR2 | LLIYDASNRAT |
| SEQ ID NO: 200 | light chain ABR3 | QQRSNWPP |
| SEQ ID NO: 201 | heavy chain ABR1 | FSLTSYGVH |
| SEQ ID NO: 202 | heavy chain ABR2 | WIGVMWRGGSTDY |
| SEQ ID NO: 203 | heavy chain ABR3 | KSMITTGFVMDS |
| SEQ ID NO: 204 | light chain ABR1 | EDIYNRLT |
| SEQ ID NO: 205 | light chain ABR2 | LLISGATSLET |
| SEQ ID NO: 206 | light chain ABR3 | QQYWSNPY |
| SEQ ID NO: 207 | heavy chain ABR1 | FDFSRSWMN |
| SEQ ID NO: 208 | heavy chain ABR2 | WIGEINPDSSTINY |
| SEQ ID NO: 209 | heavy chain ABR3 | RYGNWFPY |
| SEQ ID NO: 210 | light chain ABR1 | QNVDTNVA |
| SEQ ID NO: 211 | light chain ABR2 | ALIYSASYRYS |
| SEQ ID NO: 212 | light chain ABR3 | QQYDSYPL |
| SEQ ID NO: 213 | heavy chain ABR1 | GTFSSYAFS |
| SEQ ID NO: 214 | heavy chain ABR2 | WMGRVIPFLGIANS |
| SEQ ID NO: 215 | heavy chain ABR3 | RDDIAALGPFDY |

-continued

| Sequence Listing | | |
|---|---|---|
| ID Number | Text Description | Biological Sequence |
| SEQ ID NO: 216 | light chain ABR1 | QGISSWLA |
| SEQ ID NO: 217 | light chain ABR2 | SLIYAASSLQS |
| SEQ ID NO: 218 | light chain ABR3 | QQYNSYPR |
| SEQ ID NO: 219 | heavy chain ABR1 | YTFTDYWMQ |
| SEQ ID NO: 220 | heavy chain ABR2 | WIGTIYPGDGDTGY |
| SEQ ID NO: 221 | heavy chain ABR3 | RGDYYGSNSLDY |
| SEQ ID NO: 222 | light chain ABR1 | QDVSTVVA |
| SEQ ID NO: 223 | light chain ABR2 | RLIYSASYRYI |
| SEQ ID NO: 224 | light chain ABR3 | QQHYSPPY |
| SEQ ID NO: 225 | heavy chain CDR1 | GFSLTSYGVH |
| SEQ ID NO: 226 | heavy chain CDR2 | VMWRGGSTDYNAAFMS |
| SEQ ID NO: 227 | heavy chain CDR3 | SMITTGFVMDS |
| SEQ ID NO: 228 | light chain CDR1 | KASEDIYNRLT |
| SEQ ID NO: 229 | light chain CDR2 | GATSLET |
| SEQ ID NO: 230 | light chain CDR3 | QQYWSNPYT |
| SEQ ID NO: 231 | heavy chain CDR1 | GFSLISYGVH |
| SEQ ID NO: 232 | heavy chain CDR2 | VIWRGGSTDYNAAFMS |
| SEQ ID NO: 233 | heavy chain CDR3 | TLITTGYAMDY |
| SEQ ID NO: 234 | light chain CDR1 | KASEDIYNRLA |
| SEQ ID NO: 235 | light chain CDR2 | GATSLET |
| SEQ ID NO: 236 | light chain CDR3 | QQYWSTPT |
| SEQ ID NO: 237 | heavy chain CDR1 | GFDFSRSWMN |
| SEQ ID NO: 238 | heavy chain CDR2 | EINPDSSTINYTTSLKD |
| SEQ ID NO: 239 | heavy chain CDR3 | YGNWFPY |
| SEQ ID NO: 240 | light chain CDR1 | KASQNVDTNVA |
| SEQ ID NO: 241 | light chain CDR2 | SASYRYS |
| SEQ ID NO: 242 | light chain CDR3 | QQYDSYPLT |
| SEQ ID NO: 243 | heavy chain ABR1 | FDFSRYWMS |
| SEQ ID NO: 244 | heavy chain ABR2 | WIGEINPTSSTINF |
| SEQ ID NO: 245 | heavy chain ABR3 | RGNYYRYGDAMDY |
| SEQ ID NO: 246 | light chain ABR1 | KSVSTSGYSYLH |
| SEQ ID NO: 247 | light chain ABR2 | LLIYLASNLES |
| SEQ ID NO: 248 | light chain ABR3 | QHSRELPF |
| SEQ ID NO: 249 | heavy chain ABR1 | STFTTYWIH |
| SEQ ID NO: 250 | heavy chain ABR2 | WIGYINPNTGYTEY |
| SEQ ID NO: 251 | heavy chain ABR3 | VRFITVVGG |
| SEQ ID NO: 252 | light chain ABR1 | SSVSSSHLH |
| SEQ ID NO: 253 | light chain ABR2 | LWIYSTSNLAS |

-continued

Sequence Listing

| ID Number | Text Description | Biological Sequence |
|---|---|---|
| SEQ ID NO: 254 | light chain ABR3 | HQYHRSPL |
| SEQ ID NO: 255 | heavy chain ABR1 | FSLTTYGIGVG |
| SEQ ID NO: 256 | heavy chain ABR2 | WLTHIWWNDNKYY |
| SEQ ID NO: 257 | heavy chain ABR3 | YGYTY |
| SEQ ID NO: 258 | light chain ABR1 | QSLLYSNGNTYLH |
| SEQ ID NO: 259 | light chain ABR2 | LLIYKLSNRFS |
| SEQ ID NO: 260 | light chain ABR3 | SQSTHVPW |
| SEQ ID NO: 261 | heavy chain ABR1 | FNIKDTYIH |
| SEQ ID NO: 262 | heavy chain ABR2 | WVARIYPTNGYTRY |
| SEQ ID NO: 263 | heavy chain ABR3 | TWGGDGFYAMDY |
| SEQ ID NO: 264 | light chain ABR1 | QDVNTAVA |
| SEQ ID NO: 265 | light chain ABR2 | LLIYSASFLYS |
| SEQ ID NO: 266 | light chain ABR3 | QQHYTTPP |
| SEQ ID NO: 267 | heavy chain ABR3 | RWGGDGFYAMDV |
| SEQ ID NO: 268 | heavy chain ABR1 | YSFTSYWIA |
| SEQ ID NO: 269 | heavy chain ABR2 | YMGLIYPGDSDTKY |
| SEQ ID NO: 270 | heavy chain ABR3 | RHDVGYCSSSNCAKWPEYFQH |
| SEQ ID NO: 271 | light chain ABR1 | SSNIGNNYVS |
| SEQ ID NO: 272 | light chain ABR2 | LLIYGHTNRPA |
| SEQ ID NO: 273 | light chain ABR3 | AAWDDSLSGW |
| SEQ ID NO: 274 | heavy chain ABR1 | YPFTNYGMN |
| SEQ ID NO: 275 | heavy chain ABR2 | WMGWINTSTGESTF |
| SEQ ID NO: 276 | heavy chain ABR3 | RWEVYHGYVPY |
| SEQ ID NO: 277 | light chain ABR1 | QDVYNAVA |
| SEQ ID NO: 278 | light chain ABR2 | LLIYSASSRYT |
| SEQ ID NO: 279 | light chain ABR3 | QQHFRTPF |
| SEQ ID NO: 280 | heavy chain ABR1 | ITFSINTMG |
| SEQ ID NO: 281 | heavy chain ABR2 | LVALISSIGDTYYA |
| SEQ ID NO: 282 | heavy chain ABR3 | KRFRTAAQGTDY |
| SEQ ID NO: 283 | heavy chain CDR1 | GFNIKDTYIH |
| SEQ ID NO: 284 | heavy chain CDR2 | RIYPTNGYTRYADSVKG |
| SEQ ID NO: 285 | heavy chain CDR3 | WGGDGFYAMDY |
| SEQ ID NO: 286 | light chain CDR1 | RASQDVNTAVA |
| SEQ ID NO: 287 | light chain CDR2 | SASFLYS |
| SEQ ID NO: 288 | light chain CDR3 | QQHYTTPPT |
| SEQ ID NO: 289 | heavy chain CDR1 | GFNIKDTYIH |
| SEQ ID NO: 290 | heavy chain CDR2 | RIYPTNGYTRYADSVKG |
| SEQ ID NO: 291 | heavy chain CDR3 | WGGDGFYAMDV |

-continued

Sequence Listing

| ID Number | Text Description | Biological Sequence |
|---|---|---|
| SEQ ID NO: 292 | light chain CDR1 | RASQDVNTAVA |
| SEQ ID NO: 293 | light chain CDR2 | SASFLYS |
| SEQ ID NO: 294 | light chain CDR3 | QQHYTTPPT |
| SEQ ID NO: 295 | heavy chain CDR1 | GYSFTSYWIA |
| SEQ ID NO: 296 | heavy chain CDR2 | LIYPGDSDTKYSPSFQG |
| SEQ ID NO: 297 | heavy chain CDR3 | HDVGYCSSSNCAKWPEYFQH |
| SEQ ID NO: 298 | light chain CDR1 | SGSSSNIGNNYVS |
| SEQ ID NO: 299 | light chain CDR2 | GHTNRPA |
| SEQ ID NO: 300 | light chain CDR3 | AAWDDSLSGWV |
| SEQ ID NO: 301 | heavy chain CDR1 | GITFSINTMG |
| SEQ ID NO: 302 | heavy chain CDR2 | LISSIGDTYYADSVKG |
| SEQ ID NO: 303 | heavy chain CDR3 | FRTAAQGTDY |
| SEQ ID NO: 304 | heavy chain ABR1 | FTFSDSWIH |
| SEQ ID NO: 305 | heavy chain ABR2 | WVAWISPYGGSTYY |
| SEQ ID NO: 306 | heavy chain ABR3 | RRHWPGGFDY |
| SEQ ID NO: 307 | light chain ABR1 | QDVSTAVA |
| SEQ ID NO: 308 | light chain ABR2 | LLIYSASFLYS |
| SEQ ID NO: 309 | light chain ABR3 | QQYLYHPA |
| SEQ ID NO: 310 | heavy chain ABR1 | YTFTSYVMH |
| SEQ ID NO: 311 | heavy chain ABR2 | WIGYVNPFNDGTKY |
| SEQ ID NO: 312 | heavy chain ABR3 | RQAWGYP |
| SEQ ID NO: 313 | light chain ABR1 | ESVEYYGTSLVQ |
| SEQ ID NO: 314 | light chain ABR2 | LLIYAASSVDS |
| SEQ ID NO: 315 | light chain ABR3 | QQSRRVPY |
| SEQ ID NO: 316 | heavy chain ABR1 | YTFTSYDVH |
| SEQ ID NO: 317 | heavy chain ABR2 | WMGWLHADTGITKF |
| SEQ ID NO: 318 | heavy chain ABR3 | RERIQLWFDY |
| SEQ ID NO: 319 | light chain ABR1 | QGISSWLA |
| SEQ ID NO: 320 | light chain ABR2 | SLIYAASSLQS |
| SEQ ID NO: 321 | light chain ABR3 | QQYNSYPY |
| SEQ ID NO: 322 | heavy chain ABR1 | DTFSTYAIS |
| SEQ ID NO: 323 | heavy chain ABR2 | WMGGIIPIFGKAHY |
| SEQ ID NO: 324 | heavy chain ABR3 | RKFHFVSGSPFGMDV |
| SEQ ID NO: 325 | light chain ABR1 | QSVSSYLA |
| SEQ ID NO: 326 | light chain ABR2 | LLIYDASNRAT |
| SEQ ID NO: 327 | light chain ABR3 | QQRSNWP |
| SEQ ID NO: 328 | heavy chain ABR1 | FTFSSYIMM |
| SEQ ID NO: 329 | heavy chain ABR2 | WVSSIYPSGGITFY |

-continued

Sequence Listing

| ID Number | Text Description | Biological Sequence |
|---|---|---|
| SEQ ID NO: 330 | heavy chain ABR3 | RIKLGTVTTVDY |
| SEQ ID NO: 331 | light chain ABR1 | SSDVGGYNYVS |
| SEQ ID NO: 332 | light chain ABR2 | LMIYDVSNRPS |
| SEQ ID NO: 333 | light chain ABR3 | SSYTSSSTR |
| SEQ ID NO: 334 | heavy chain CDR1 | GFNIKDYFLH |
| SEQ ID NO: 335 | heavy chain CDR2 | WINPDNGNTVYDPKFQG |
| SEQ ID NO: 336 | heavy chain CDR3 | RDYTYEKAALDY |
| SEQ ID NO: 337 | light chain CDR1 | RASGNIYNYLA |
| SEQ ID NO: 338 | light chain CDR2 | DAKTLAD |
| SEQ ID NO: 339 | light chain CDR3 | QHFWSLPFT |
| SEQ ID NO: 340 | SLT-1A-combo27 | KEFILRFSVAHKYVDSLNVIRSAIGTPLQTISSGGTSL<br>LMIDSGSGDNLFAVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNCHHHASAVAA |
| SEQ ID NO: 341 | SLT-1A-combo28 | KEFTLDFSTAKTYVDSLNVIRSAIGTPLQTISSGGTSL<br>LMIDNLVPMVATVVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNCHHHASAVAA |
| SEQ ID NO: 342 | SLT-1A-combo29 | KEFTLDFSTAKTYVDSLNVIRSAIGTPLQTISSGGTSL<br>LMIDSNLVPMVATVDVRGIDPEEGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNCHHHASAVAA |
| SEQ ID NO: 343 | SLT-1A-combo30 | KEFTLDFSTAKTYVDSLNVIRSAIGTPLQTISSGGTSL<br>LMIDSGILGFVFTLDVRGIDPEEGRFNNLRLIVERNN<br>LYVTGFVNRTNNVFYRFADFSHVTFPGTTAVTLSG<br>DSSYTTLQRVAGISRTGMQINRHSLTTSYLDLMSHS<br>GTSLTQSVARAMLRFVTVTAEALRFRQIQRGFRTTL<br>DDLSGRSYVMTAEDVDLTLNWGRLSSVLPDYHGQ<br>DSVRVGRISFGSINAILGSVALILNCHHHASAVAA |
| SEQ ID NO: 344 | SLT-1A-combo31 | KEFTLDFSTAKTYVDSLNVIRSAIGTPLQTISSGGTSL<br>LMIDSGSGDNLFAVGILGFDFTLGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNCHHHASAVAA |
| SEQ ID NO: 345 | SLT-1A-combo32 | KEFTLDFSTAKTYVDSLNVIRSAIGTPLQTISSGGTSL<br>LMIDSGSGDNLFAVDILGFVFTLGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNCHHHASAVAA |
| SEQ ID NO: 346 | SLT-1A-combo33 | KEFTLDFSTAKTYVDSLNVIRSAIGTPLQTISSGGTSL<br>LMIDSGSGDNLFAVDILGFDFTLGRFNNLRLIVERN<br>NLYVTGFVNRTNNVFYRFADFSHVTFPGTTAVTLS<br>GDSSYTTLQRVAGISRTGMQINRHSLTTSYLDLMSH<br>SGTSLTQSVARAMLRFVTVTAEALRFRQIQRGFRTT<br>LDDLSGRSYVMTAEDVDLTLNWGRLSSVLPDYHG<br>QDSVRVGRISFGSINAILGSVALILNCHHHASAVAA |

-continued

Sequence Listing

| ID Number | Text Description | Biological Sequence |
|---|---|---|
| SEQ ID NO: 347 | SLT-1A-combo34 | KEFTLDFSTAKTYVDSLNVIRSAIGTPLQTISSGGTSL LMIDSGSGDNLFAVGILGFVFTLGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASAVAA |
| SEQ ID NO: 348 | SLT-1A-combo35 | KEFILDFSTAKTYVDSLNVIRSAIGTPLQTISSGGTSL LMIDSGIGDNLFAVDVRGIAPIEARFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL AALSGASYVMTAEDVDLTLNWGRLSSVLPDYHGQ DSVRVGRISFGSINAILGSVALILNSHHHASAVAA |
| SEQ ID NO: 349 | SLT-1A-combo36 | KEFTLDFSTAKTYVDSLNVIRSAIGTPLQTISSGGTSL LMIDSGSGDNLFAVGILGFVFTLEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASAVAA |
| SEQ ID NO: 350 | SLT-1A-combo37 | KEFTLDFSTAKTYVDSLNVIRSAIGTPLQTISSGGTSL LMIDSGSGDNLFAVNLVPMVATVGRFNNLRLIVER NNLYVTGFVNRTNNVFYRFADFSHVTFPGTTAVTL SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASAVAA |
| SEQ ID NO: 351 | SLT-1A-combo38 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTNLVPMV ATVSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASAVAA |
| SEQ ID NO: 352 | SLT-1A-combo39 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRGI LGDVFTLSYVMTAEDVDLTLNWGRLSSVLPDYHG QDSVRVGRISFGSINAILGSVALILNSHHHASAVAA |
| SEQ ID NO: 353 | SLT-1A-combo40 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHILRFSVA HKASAVAA |
| SEQ ID NO: 354 | SLT-1A-combo41 | KEFTLDFSTAKTYVDSLNVIRSAIGTPLQTISSGGTSL LMIDSGSGDNLFAVDILGFDFTLGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHARNLVP MVATVASAVAA |
| SEQ ID NO: 355 | SLT-1A-base1 | KEFILRFSVAHKYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASRVAR |

-continued

Sequence Listing

| ID Number | Text Description | Biological Sequence |
|---|---|---|
| SEQ ID NO: 356 | SLT-1A-base2 and StxA-base 1 | KEFTLDFSTAKTYVDSLNVIRSAIGTPLQTISSGGTSL LMIDNLVPMVATVVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASRVAR |
| SEQ ID NO: 357 | SLT-1A-base3 and StxA-base2 | KEFTLDFSTAKTYVDSLNVIRSAIGTPLQTISSGGTSL LMIDSNLVPMVATVDVRGIDPEEGRFNNLRLIVERN ANLYVTGFVNRTNNVFYRFADFSHVTFPGTTAVTLS AGDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASRVAR |
| SEQ ID NO: 358 | SLT-1A-base4 and StxA-base3 | KEFTLDFSTAKTYVDSLNVIRSAIGTPLQTISSGGTSL LMIDSGILGFVFTLDVRGIDPEEGRFNNLRLIVERNN LYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGRSYVMTAEDVDLTLNWGRLSSVLPDYHGQ DSVRVGRISFGSINAILGSVALILNCHHHASRVAR |
| SEQ ID NO: 359 | SLT-1A-base5 | KEFTLDFSTAKTYVDSLNVIRSAIGTPLQTISSGGTSL LMIDSGSGDNLFAVGILGFDFTLGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASRVAR |
| SEQ ID NO: 360 | SLT-1A-base6 | KEFTLDFSTAKTYVDSLNVIRSAIGTPLQTISSGGTSL LMIDSGSGDNLFAVDILGFVFTLGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASRVAR |
| SEQ ID NO: 361 | SLT-1A-base7 | KEFTLDFSTAKTYVDSLNVIRSAIGTPLQTISSGGTSL LMIDSGSGDNLFAVDILGFDFTLGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASRVAR |
| SEQ ID NO: 362 | SLT-1A-base8 | KEFTLDFSTAKTYVDSLNVIRSAIGTPLQTISSGGTSL LMIDSGSGDNLFAVGILGFVFTLGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASRVAR |
| SEQ ID NO: 363 | SLT-1A-base9 and StxA-base4 | KEFILDFSTAKTYVDSLNVIRSAIGTPLQTISSGGTSL LMIDSGIGDNLFAVDVRGIAPIEARFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL AALSGASYVMTAEDVDLTLNWGRLSSVLPDYHGQ DSVRVGRISFGSINAILGSVALILNSHHHASRVAR |
| SEQ ID NO: 364 | SLT-1Abase10 | KEFTLDFSTAKTYVDSLNVIRSAIGTPLQTISSGGTSL LMIDSGSGDNLFAVGILGFVFTLEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASRVAR |
| SEQ ID NO: 365 | SLT-1Abase11 | KEFTLDFSTAKTYVDSLNVIRSAIGTPLQTISSGGTSL LMIDSGSGDNLFAVNLVPMVATVGRFNNLRLIVER NNLYVTGFVNRTNNVFYRFADFSHVTFPGTTAVTL |

-continued

Sequence Listing

| ID Number | Text Description | Biological Sequence |
|---|---|---|
| | | SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASRVAR |
| SEQ ID NO: 366 | SLT-1Abase12 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTNLVPMV ATVSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASRVAR |
| SEQ ID NO: 367 | SLT-1Abase13 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRGI LGDVFTLSYVMTAEDVDLTLNWGRLSSVLPDYHG QDSVRVGRISFGSINAILGSVALILNSHHHASRVAR |
| SEQ ID NO: 368 | SLT-1Abase14 | KEFTLDFSTAKTYVDSLNVIRSAIGTPLQTISSGGTSL LMIDSGSGDNLFAVDVRGIDPEEGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHILRFSVA HKASRVAR |
| SEQ ID NO: 369 | SLT-1Abase15 | KEFTLDFSTAKTYVDSLNVIRSAIGTPLQTISSGGTSL LMIDSGSGDNLFAVDILGFDFTLGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHARNLVP MVATVASRVAR |
| SEQ ID NO: 370 | Shiga Toxin A Subunit Effector Polypeptide combo101 | KEFILRFSVAHKYVDSLNVIRSAIGTPLQTISSGGTSL LMIDSGIGDNLFAVDVRGIDPEEGRFNNLRLIVERN NLYVTGFVNATNNAFYRFADFSHVTFPGTTAVTLS ADSSYTTLQRVAGISRTGMQINRHSLTTSYLDLMSH SGTSLTQSVARAMLRFVTVTAEALRFRQIQRGFRTT LDDLSGASYVMTAEDVDLTLNWGRLSSVLPDYHG QDSVRVGRISFGSINAILGSVALILNSHHHASAVAA |
| SEQ ID NO: 371 | Shiga Toxin A Subunit Effector Polypeptide combo102 | AEFILRFSVAHKYVDSLNVIRSAIGTPLQTISSGGTSL LMIDSGIGDNLFAVDVRGIDPEEGRFNNLRLIVERN NLYVTGFVNATNNAFYRFADFSHVTFPGTTAVTLS ADSSYTTLQRVAGISRTGMQINRHSLTTSYLDLMSH SGTSLTQSVARAMLRFVTVTAEALRFRQIQRGFRTT LDDLSGASYVMTAEDVDLTLNWGRLSSVLPDYHG QDSVRVGRISFGSINAILGSVALILNSHHHASAVAA |
| SEQ ID NO: 372 | Shiga Toxin A Subunit Effector Polypeptide combo103 | KEFTLDFSTAKTYVDSLNVIRSAIGTPLQTISSGGTSL LMIDNLVPMVATVVDVRGIDPEEGRFNNLRLIVERN NLYVTGFVNATNNVFYRFADFSHVTFPGTTAVTLS ADSSYTTLQRVAGISRTGMQINRHSLTTSYLALMSH SGTSLTQSVARAMLRFVTVTAEALRFRQIQRGFRTT LDDLSGASYVMTAEDVDLTLNWGRLSSVLPDYHG QDSVRVGRISFGSINAILGSVALILNSHHHASAVAA |
| SEQ ID NO: 373 | Shiga Toxin A Subunit Effector Polypeptide combo104 | KEFILRFSVAHKYVDSLNVIRSAIGTPLQTISSGGTSL LMIDSGIGDNLFAVDVRGIDPEEGRFNNLRLIVERN NLYVTGFVNATNNAFYRFADFSHVTFPGTTAVTLS ADSSYTTLQRVAGISRTGMQINRHSLTTSYLDLMSH SGTSLTQSVARAMLRFVTVTAEALRFRQIQRGFRTT LDDLSGASYVMTAEDVALTLNWGRLSSVLPDYHG QDSVRVGRISFGSINAILGSVALILNSHHHASAVAA |
| SEQ ID NO: 374 | Shiga Toxin A Subunit Effector Polypeptide combo105 | KEFTLDFSTAKTYVDSLNVIRSAIGTPLQTISSGGTSL LMIDSNLVPMVATVDVRGIDPEEGRFNNLRLIVERN NLYVTGFVNATNNVFYRFADFSHVTFPGTTAVTLS ADSSYTTLQRVAGISRTGMQINRHSLTTSYLDLMSH |

-continued

Sequence Listing

| ID Number | Text Description | Biological Sequence |
|---|---|---|
| | | SGTSLTQSAARAMLRFVTVTAEALRFRQIQRGFRTT LDDLSGASYVMTAEDVDLTLNWGRLSSVLPDYHG QDSVRVGRISFGSINAILGSVALILNSHHHASAVAA |
| SEQ ID NO: 375 | Shiga Toxin A Subunit Effector Polypeptide combo106 | KEFTLDFSTAKTYVDSLNVIRSAIGTPLQTISSGGTSL LMIDSNLVPMVATVDVRGIDPEEGRFNNLRLIVERN NLYVTGFVNATNNVFYRFADFSHVTFPGTTAVTLS ADSSYTTLQRVAGISRTGMQINRHSLTTSYLDLMSH SGTSLTQSAARAMLRFVTVTAEALRFRQIQRGFRTT LDDLSGASYVMTAEDVDLTLNWGALSSVLPDYHG QDSVRVGRISFGSINAILGSVALILNSHHHASAVAA |
| SEQ ID NO: 376 | Shiga Toxin A Subunit Effector Polypeptide combo 107 | KEFTLDFSTAKTYVDSLNVIRSAIGTPLQTISSGGTSL LMIDSGILGFVFTLDVRGIDPEEGRFNNLRLIVERNN LYVTGFVNATNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 377 | Shiga Toxin A Subunit Effector Polypeptide combo 108 | KEFTLDFSTAKTYVDSLNVIRSAIGTPLQTISSGGTSL LMIDSGILGFVFTLDVRGIDPEEGRFNNLRLIVERNN LYVTGFVNATNNAFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 378 | Shiga Toxin A Subunit Effector Polypeptide combo109 | KEFTLDFSTAKTYVDSLNVIRSAIGTPLQTISSGGTSL LMIDSGIGDNLFAVDILGFDFTLGRFNNLRLIVERNN LYVTGFVNRTNNAFYRFADFSHVTFPGTTAVTLSA DSSYTTLQRVAGISRTGMQINRHSLTTSYLALMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 379 | Shiga Toxin A Subunit Effector Polypeptide combo110 | KEFILDFITAKTYVDSLNVIRSAIGTPLQTISSGGTSLL MIDSGIGDNLFAVDILGFDFTLGRFNNLRLIVERNNL YVTGFVNRTNNAFYRFADFSHVTFPGTTAVTLSADS SYTTLQRVAGISRTGMQINRHSLTTSYLALMSHSGT SLTQSVARAMLRFVTVTAEALRFRQIQRGFRTTLDD LSGASYVMTAEDVDLTLNWGRLSSVLPDYHGQDS VRVGRISFGSINAILGSVALILNSHHHASAVAA |
| SEQ ID NO: 380 | Shiga Toxin A Subunit Effector Polypeptide combo111 | KEFTLDFSTAKTYVDSLNVIRSAIGTPLQTISSGGTSL LMIDSGIGDNLFAVGILGFDFTLGRFNNLRLIVERNN LYVTGFVNATNNAFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 381 | Shiga Toxin A Subunit Effector Polypeptide combo112 | MEFTLDFSTAKTYVDSLNVIRSAIGTPLQTISIGGTSL LMIDSGIGDNLFAVGILGFDFTLGRFNNLRLIVERNN LYVTGFVNATNNVFYRFADFSHVTFPGTTAVTLSA DSSYTTLQRVAGISRTGMQINRHSLTTSYLALMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 382 | Shiga Toxin A Subunit Effector Polypeptide combo113 | KEFTLDFSTAKTYVDSLNVIRSAIGTPLQTISSGGTSL LMIDSGIGDNLFAVGILGFDFTLGRFNNLRLIVERNN LYVTGFVNATNNVFYRFADFSHVTFPGTTAVTLSA DSSYTTLQRVAGISRTGMQINRHSLTTSYLALMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNCHHHASAVAA |
| SEQ ID NO: 383 | Shiga Toxin A Subunit Effector Polypeptide combo114 | KEFTLDFSTAKTYVDSLNVIRSAIGTPLQTISSGGTSL LMIDSGIGDNLFAVGILGFDFTLGRFNNLRLIVERNN LYVTGFVNATNNVFYRFADFSHVTFPGTTAVTLSA DSSYTTLQRVAGISRTGMQINRHSLTTSYLALMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |

-continued

| Sequence Listing | | |
|---|---|---|
| ID Number | Text Description | Biological Sequence |
| SEQ ID NO: 384 | Shiga Toxin A Subunit Effector Polypeptide combo115 | KEFTLDFSTAKTYVDSLNVIRSAIGTPLQTISSGGTSL LMIDSGIGDNLFAVDILGFVFTLGRFNNLRLIVERNN LYVTGFVNATNNVFYRFADFSHVTFPGTTAVTLSA DSSYTTLQRVAGISRTGMQINRHSLTTSYLDLMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 385 | Shiga Toxin A Subunit Effector Polypeptide combo116 | AEFTLDFITAKTYVDSLNVIRSAIGTPLQTISSGGTSL LMIDSGIGDNLFAVDILGFVFTLGRFNNLRLIVERNN LYVTGFVNATNNVFYRFADFSHVTFPGTTAVTLSA DSSYTTLQRVAGISRTGMQINRHSLTTSYLDLMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNCHHHASAVAA |
| SEQ ID NO: 386 | Shiga Toxin A Subunit Effector Polypeptide combo117 | KEFTLDFSTAKTYVDSLNVIRSAIGTPLQTISSGGTSL LMIDSGIGDNLFAVDILGFDFTLGRFNNLRLIVERNN LYVTGFVNATNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 387 | Shiga Toxin A Subunit Effector Polypeptide combo118 | KEFTLDFSIAATYVDSLNVIRSAIGTPLQTISSGGTSL LMIDSGIGDNLFAVDILGFDFTLGRFNNLRLIVERNN LYVTGFVNATNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 388 | Shiga Toxin A Subunit Effector Polypeptide combo119 | KEFTLDFSTAKTYVDSLNVIRSAIGTPLQTISSGGTSL LMIDSGIGDNLFAVDILGFVFTLGRFNNLRLIVERNN LYVTGFVNRTNNAFYRFADFSHVTFPGTTAVTLSA DSSYTTLQRVAGISRTGMQINRHSLTTSYLALMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 389 | Shiga Toxin A Subunit Effector Polypeptide combo120 | KEFTLDFSTAKTYVDSLNVIRSAIGTPLQTISSGGTSL LMIDSGIGDNLFAVDILGFVFTLGRFNNLRLIVERNN LYVTGFVNRTNNAFYRFADFSHVTFPGTTAVTLSA DSSYTTLQRVAGISRTGMQINRHSLTTSYLALMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 390 | Shiga Toxin A Subunit Effector Polypeptide combo121 | KEFTLDFSTAKTYVDSLNVIRSAIGTPLQTISSGGTSL LMIDSGIGDNLFAVGILGFDFTLGRFNNLRLIVERNN LYVTGFVNRTNNAFYRFADFSHVTFPGTTAVTLSA DSSYTTLQRVAGISRTGMQINRHSLTTSYLDLMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 391 | Shiga Toxin A Subunit Effector Polypeptide combo122 | KEFTLDFSTAKTYVDSLNVIRSAIGTPLQTISSGGTSL LMIDSGIGDNAFAVGILGFDFTLGRFNNLRLIVERNN LYVTGFVNRTNNAFYRFADFSHVTFPGTTAVTLSA DSSYTTLQRVAGISRTGMQINRHSLTTSYLDLMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 392 | Shiga Toxin A Subunit Effector Polypeptide combo123 | KEFTLDFSTAKTYVDSLNVIRSAIGTPLQTISSGGTSL LMIDSGIGDNLFAVDILGFDFTLGRFNNLRLIVERNN LYVTGFVNRTNNAFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |

-continued

Sequence Listing

| ID Number | Text Description | Biological Sequence |
|---|---|---|
| SEQ ID NO: 393 | Shiga Toxin A Subunit Effector Polypeptide combo124 | KEFTLDFSTAKTYVDSLNVIRSAIGTPLQTISSGGTSL LMIDSGIGDNLTAVDILGFDFTLGRFNNLRLIVERNN LYVTGFVNRTNNAFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 394 | Shiga Toxin A Subunit Effector Polypeptide combo125 | KEFTLDFSTAKTYVDSLNVIRSAIGTPLQTISSGGTSL LMIDSGIGDNLFAVGILGFDFTLGRFNNLRLIVERNN LYVTGFVNRTNNVFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 395 | Shiga Toxin A Subunit Effector Polypeptide combo126 | KEFTLDFSTAKTYVDSLNVIRSAIGTPLQTISSGGTSL LMIDSGIGDNLFVVGILGFDFTLGRFNNLRLIVERNN LYVTGFVNRTNNVFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 396 | Shiga Toxin A Subunit Effector Polypeptide combo127 | KEFTLDFSTAKTYVDSLNVIRSAIGTPLQTISSGGTSL LMIDSGIGDNLFAVGILGVDFTLGRFNNLRLIVERNN LYVTGFVNRTNNVFYRFADFSHVTFPGTTAVTLSA DSSYTTLQRVAGISRTGMQINRHSLTTSYLALMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 397 | Shiga Toxin A Subunit Effector Polypeptide combo128 | MEFTLDFSTAKTYVDSLNVIRSAIGTPLQTISSGGTS LLMIDSGIGDNLFAVGILGVDFTLGRFNNLRLIVERN NLYVTGFVNRTNNVFYRFADFSHVTFPGTTAVTLS ADSSYTTLQRVAGISRTGMQINRHSLTTSYLALMSH SGTSLTQSVARAMLRFVTVTAEALRFRQIQRGFRTT LDDLSGASYVMTAEDVALTLNWGRLSSVLPDYHG QDSVRVGRISFGSINAILGSVALILNSHHHASAVAA |
| SEQ ID NO: 398 | Shiga Toxin A Subunit Effector Polypeptide combo129 | KEFTLDFSTAKTYVDSLNVIRSAIGTPLQTISSGGTSL LMIDSGIGDNLFAVDILGFDFTLEGRFNNLRLIVERN NLYVTGFVNRTNNVFYRFADFSHVTFPGTTAVTLS ADSSYTTLQRVAGISRTGMQINRHSLTTSYLDLMSH SGTSLTQSAARAMLRFVTVTAEALRFRQIQRGFRTT LDDLSGASYVMTAEDVALTLNWGRLSSVLPDYHG QDSVRVGRISFGSINAILGSVALILNSHHHASAVAA |
| SEQ ID NO: 399 | Shiga Toxin A Subunit Effector Polypeptide combo130 | KEFTLDFSTAKTYVDSLNVIRSAIGTPLQTISSGGTSL LMIDSGIGDNLFAVDILGFDFTLEGRFNNLRLIVERN NLYVTGFVNRTNNVFYRFADFSHVTFPGTTAVTLS ADSSYTTLQRVAGISRTGMQINRHSLTTSYLDLMSH SGTSLTQSAARAMLRFVTVTAEALRFRQIQRGFRTT LDDLSGASYVMTAEDVALTLNWGRLSSVLPDYHG QDSVRVGRISFGSINAILGSVALILNCHHHASAVAA |
| SEQ ID NO: 400 | Shiga Toxin A Subunit Effector Polypeptide combo131 | KEFTLDFSTAKTYVDSLNVIRSAIGTPLQTISSGGTSL LMIDSGIGDNLFAVGILGFVFTLEGRFNNLRLIVERN NLYVTGFVNATNNAFYRFADFSHVTFPGTTAVTLS ADSSYTTLQRVAGISRTGMQINRHSLTTSYLALMSH SGTSLTQSVARAMLRFVTVTAEALRFRQIQRGFRTT LDDLSGASYVMTAEDVDLTLNWGRLSSVLPDYHG QDSVRVGRISFGSINAILGSVALILNSHHHASAVAA |
| SEQ ID NO: 401 | Shiga Toxin A Subunit Effector Polypeptide combo132 | KEFTLDFSTAKTYVDSLNVIRSAIGTPLQTISSGGTSL LMIDSGIGDNLFAVGILGFVFTLEGRFNNLRLIVERN NLYVTGFVNATNNAFYRFADFSHVTFPGTTAVTLS ADSSYTTLQRVAGISRTGMQINRHSLTTSYLALMSH SGTSLTQSVARAMLRFVTVTAEALRFRQIQRGFRTT LDDLSGASYVMTAEDVALTLNWGRLSSVLPDYHG QDSVRVGRISFGSINAILGSVALILNSHHHASAVAA |

-continued

Sequence Listing

| ID Number | Text Description | Biological Sequence |
|---|---|---|
| SEQ ID NO: 402 | Shiga Toxin A Subunit Effector Polypeptide combo133 | KEFTLDFSTAKTYVDSLNVIRSAIGTPLQTISSGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLDLMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 403 | Shiga Toxin A Subunit Effector Polypeptide combo134 | AEFILDFIAAKTYVDSLNVIRSAIGTPLQTISSGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLDLMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 404 | Shiga Toxin A Subunit Effector Polypeptide combo135 | KEFTLDFSTAKTYVDSLNVIRSAIGTPLQTISSGGTSL LMIDSGIGDNLFAVDILGFVFTLGRFNNLRLIVERNN LYVTGFVNATNNAFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 405 | Shiga Toxin A Subunit Effector Polypeptide combo136 | KEFTLDFSTAKTYVDSLNVIRSAIGTPLQTISCGGTSL LMIDSGIGDNLFAVDILGFVFTLGRFNNLRLIVERNN LYVTGFVNATNNAFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 406 | Shiga Toxin A Subunit Effector Polypeptide combo137 | KEFTLDFSTAKTYVDSLNVIRSAIGTPLQTISSGGTSL LMIDSGIGDNLFAVGILGFVFTLGRFNNLRLIVERNN LYVTGFVNATNNVFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 407 | Shiga Toxin A Subunit Effector Polypeptide combo138 | MEFILDFSTAKTYVDSLNVIRSAIGTPLQTISSGGTSL LMIDSGIGDNLFAVGILGFVFTLGRFNNLRLIVERNN LYVTGFVNATNNVFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNCHHHASAVAA |
| SEQ ID NO: 408 | Shiga Toxin A Subunit Effector Polypeptide combo139 | KEFTLDFSTAKTYVDSLNVIRSAIGTPLQTISSGGTSL LMIDSGIGDNLFAVDILGFDFTLGRFNNLRLIVERNN LYVTGFVNATNNVFYRFADFSHVTFPGTTAVTLSA DSSYTTLQRVAGISRTGMQINRHSLTTSYLALMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 409 | Shiga Toxin A Subunit Effector Polypeptide combo140 | KEFTLDFSTAKTYVDSLNVIRSAIGTPLQTISSGGTSL LMIDSGIGDNLFAVDILGFDFTLGRFNNLRLIVERNN LYVTGFVNATNNVFYRFADFSHVTFPGTTAVTLSA DSSYTTLQRVAGISRTGMQINRHSLTTSYLALMSHS GTSLTQSVARAMLRFVTVTAEALRFRQIQRGFRTTL DDLSGASYVMTAEDVALTLNWGALSSVLPDYHGQ DSVRVGRISFGSINAILGSVALILNSHHHASAVAA |
| SEQ ID NO: 410 | Shiga Toxin A Subunit Effector Polypeptide combo141 | KEFTLDFSTAKTYVDSLNVIRSAIGTPLQTISSGGTSL LMIDSGIGDNLFAVDILGFVFTLGRFNNLRLIVERNN LYVTGFVNATNNVFYRFADFSHVTFPGTTAVTLSA DSSYTTLQRVAGISRTGMQINRHSLTTSYLDLMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHASAVAA |

-continued

Sequence Listing

| ID Number | Text Description | Biological Sequence |
|---|---|---|
| SEQ ID NO: 411 | Shiga Toxin A Subunit Effector Polypeptide combo142 | AEFTLDFSTAKTYVDSLNVIRSAIGTPLQTISCGGTSL LMIDSGIGDNLFAVDILGFVFTLGRFNNLRLIVERNN LYVTGFVNATNNVFYRFADFSHVTFPGTTAVTLSA DSSYTTLQRVAGISRTGMQINRHSLTTSYLDLMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 412 | Shiga Toxin A Subunit Effector Polypeptide combo143 | KEFTLDFSTAKTYVDSLNVIRSAIGTPLQTISSGGTSL LMIDSGIGDNLFAVGILGFDFTLGRFNNLRLIVERNN LYVTGFVNRTNNAFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 413 | Shiga Toxin A Subunit Effector Polypeptide combo144 | KEFTLDFSTAKTYVDSLNVIRSAIGTPLQTISSGGTSL LMIDSGIGDNATAVGILGFDFTLGRFNNLRLIVERNN LYVTGFVNRTNNAFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 414 | Shiga Toxin A Subunit Effector Polypeptide combo145 | KEFTLDFSTAKTYVDSLNVIRSAIGTPLQTISSGGTSL LMIDSGIGDNLFAVGILGFDFTLGRFNNLRLIVERNN LYVTGFVNRTNNAFYRFADFSHVTFPGTTAVTLSA DSSYTTLQRVAGISRTGMQINRHSLTTSYLALMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 415 | Shiga Toxin A Subunit Effector Polypeptide combo146 | KEFTLDFIIAKTYVDSLNVIRSAIGTPLQTISCGGTSL LMIDSGIGDNLFAVGILGFDFTLGRFNNLRLIVERNN LYVTGFVNRTNNAFYRFADFSHVTFPGTTAVTLSA DSSYTTLQRVAGISRTGMQINRHSLTTSYLALMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 416 | Shiga Toxin A Subunit Effector Polypeptide combo147 | KEFTLDFSTAKTYVDSLNVIRSAIGTPLQTISSGGTSL LMIDSGIGDNLFAVGILGFDFTLGRFNNLRLIVERNN LYVTGFVNRTNNAFYRFADFSHVTFPGTTAVTLSA DSSYTTLQRVAGISRTGMQINRHSLTTSYLDLMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 417 | Shiga Toxin A Subunit Effector Polypeptide combo148 | KEFTLDFSTAKTYVDSLNVIRSAIGTPLQTISCGGTSL LMIDSGIGDNLFAVGILGFDFTLGRFNNLRLIVERNN LYVTGFVNRTNNAFYRFADFSHVTFPGTTAVTLSA DSSYTTLQRVAGISRTGMQINRHSLTTSYLDLMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 418 | Shiga Toxin A Subunit Effector Polypeptide combo149 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 419 | Shiga Toxin A Subunit Effector Polypeptide combo150 | AEFTLDFSTAKTYVDSLNVIRSAIGTPLQTISSGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHASAVAA |

-continued

Sequence Listing

| ID Number | Text Description | Biological Sequence |
|---|---|---|
| SEQ ID NO: 420 | Shiga Toxin A Subunit Effector Polypeptide combo151 | KEFTLDFSTAKTYVDSLNVIRSAIGTPLQTISSGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNSHHHASAVAA |
| SEQ ID NO: 421 | Shiga Toxin A Subunit Effector Polypeptide combo152 | KEFTLDFSTAKTYVDSLNVIRSAIGTPLQTISSGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVDLTLNWGRLSSVLPDYHGQ DSVRVGRISFGSINAILGSVALILNCHHHASAVAA |
| SEQ ID NO: 422 | Shiga Toxin A Subunit Effector Polypeptide combo153 | KEFTLDFSTAKTYVDSLNVIRSAIGTPLQTISSGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLALMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 423 | Shiga Toxin A Subunit Effector Polypeptide combo154 | MEFTLDFSTAKTYVDSLNVIRSAIGTPLQTISSGGTS LLMIDSGIGDNLFAVDILGFDFTLGRFNNLRLIVERN NLYVTGFVNATNNAFYRFADFSHVTFPGTTAVTLS ADSSYTTLQRVAGISRTGMQINRHSLTTSYLALMSH SGTSLTQSVARAMLRFVTVTAEALRFRQIQRGFRTT LDDLSGASYVMTAEDVALTLNWGRLSSVLPDYHG QDSVRVGRISFGSINAILGSVALILNCHHHASAVAA |
| SEQ ID NO: 424 | Shiga Toxin A Subunit Effector Polypeptide combo155 | KEFTLDFSTAKTYVDSLNVIRSAIGTPLQTISSGGTSL LMIDSGIGDNLFAVDILGFDFTLGRFNNLRLIVERNN LYVTGFVNATNNVFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 425 | Shiga Toxin A Subunit Effector Polypeptide combo156 | KEFTLDFSTAKTYVDSLNVIRSAIGTPLQTISSGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 426 | Shiga Toxin A Subunit Effector Polypeptide combo157 | KEFTLDFSTAKTYVDSLNVIRSAIGTPLQTISSGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLDLMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 427 | Shiga Toxin A Subunit Effector Polypeptide combo158 | AEFILDFSTAKTYVDSLNVIRSAIGTPLQTISCGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLDLMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 428 | Shiga Toxin A Subunit Effector Polypeptide combo159 | KEFTLDFSTAKTYVDSLNVIRSAIGTPLQTISSGGTSL LMIDSGIGDNLFAVDILGFDFTLGRFNNLRLIVERNN LYVTGFVNRTNNAFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHASAVAA |

-continued

Sequence Listing

| ID Number | Text Description | Biological Sequence |
|---|---|---|
| SEQ ID NO: 429 | Shiga Toxin A Subunit Effector Polypeptide combo160 | KEFTLDFSTAKTYVDSLNVIRSAIGTPLQTISSGGTSL LMIDSGIGDNLFAVDILGFDFTLGRFNNLRLIVERNN LYVTGFVNRTNNAFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVALTLNWGALSSVLPDYHGQ DSVRVGRISFGSINAILGSVALILNSHHHASAVAA |
| SEQ ID NO: 430 | Shiga Toxin A Subunit Effector Polypeptide combo161 | KEFTLDFSTAKTYVDSLNVIRSAIGTPLQTISSGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 431 | Shiga Toxin A Subunit Effector Polypeptide combo162 | KEFTLDFSTAKTYVDSLNVIRSAIGTPLQTISSGGTSL LMIDSGIGDNLFAVDILGFDFTLGRFNNLRLIVERNN LYVTGFVNRTNNAFYRFADFSHVTFPGTNLVPMVA TVSYTTLQRVAGISRTGMQINRHSLTTSYLDLMSHS GTSLTQSVARAMLRFVTVTAEALRFRQIQRGFRTTL DDLSGASYVMTAEDVALTLNWGRLSSVLPDYHGQ DSVRVGRISFGSINAILGSVALILNSHHHASAVAA |
| SEQ ID NO: 432 | Shiga Toxin A Subunit Effector Polypeptide combo163 | KEFTLDFSTAKTYVDSLNVIRSAIGTPLQTISSGGTSL LMIDSGIGDNLFAVDILGFDFTLGRFNNLRLIVERNN LYVTGFVNRTNNAFYRFADFSHVTFPGTNLVPMVA TVSYTTLQRVAGISRTGMQINRHSLTTSYLDLMSHS GTSLTQSVARAMLRFVTVTAEALRFRQIQRGFRTTL DDLSGASYVMTAEAVALTLNWGRLSSVLPDYHGQ DSVRVGRISFGSINAILGSVALILNSHHHASAVAA |
| SEQ ID NO: 433 | Shiga Toxin A Subunit Effector Polypeptide combo164 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLALMSHS GTSLTQSAARAMLRFVTVTAEALRFRQIQRGFRGIL GDVFTLSYVMTAEDVDLTLNWGRLSSVLPDYHGQ DSVRVGRISFGSINAILGSVALILNSHHHASAVAA |
| SEQ ID NO: 434 | Shiga Toxin A Subunit Effector Polypeptide combo165 | AEFILDFSIAKTYVDSLNVIRSAIGTPLQTISSGGTSLL MIDSGIGDNLFAVDILGFDFTLGRFNNLRLIVERNNL YVTGFVNRTNNVFYRFADFSHVTFPGTTAVTLSADS SYTTLQRVAGISRTGMQINRHSLTTSYLALMSHSGT SLTQSAARAMLRFVTVTAEALRFRQIQRGFRGILGD VFTLSYVMTAEDVDLTLNWGRLSSVLPDYHGQDSV RVGRISFGSINAILGSVALILNSHHHASAVAA |
| SEQ ID NO: 435 | Shiga Toxin A Subunit Effector Polypeptide combo166 | KEFTLDFSTAKTYVDSLNVIRSAIGTPLQTISSGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHILRFSVAHK ASAVAA |
| SEQ ID NO: 436 | Shiga Toxin A Subunit Effector Polypeptide combo167 | KEFTLDFSTAKTYVDSLNVIRSAIGTPLQTISSGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVALTLNWGALSSVLPDYHGQ DSVRVGRISFGSINAILGSVALILNSHHHILRFSVAHK ASAVAA |
| SEQ ID NO: 437 | Shiga Toxin A Subunit Effector Polypeptide combo168 | KEFTLDFSTAKTYVDSLNVIRSAIGTPLQTISSGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHARNLVPMV ATVASAVAA |

-continued

| Sequence Listing | | |
|---|---|---|
| ID Number | Text Description | Biological Sequence |
| SEQ ID NO: 438 | Shiga Toxin A Subunit Effector Polypeptide combo169 | MEFTLDFIIAKTYVDSLNVIRSAIGTPLQTISCGGTSL LMIDSGIGDNLFAVDILGFDFTLGRFNNLRLIVERNN LYVTGFVNATNNAFYRFADFSHVTFPGTTAVTLSA DSSYTTLQRVAGISRTGMQINRHSLTTSYLALMSHS GTSLTQSAARAMLRFVTVTAEALRFRQIQRGFRTTL DDLSGASYVMTAEDVALTLNWGRLSSVLPDYHGQ DSVRVGRISFGSINAILGSVALILNSHHHARNLVPMV ATVASAVAA |
| SEQ ID NO: 439 | Cell-targeting molecule 1 | KEFTLDFSTAKTYYDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGSTSGSGKPGSGEGSTKGQVQLQES GPGLVRPSQTLSLTCTVSGFSLTSYGVHWVRQPPGR GLEWIGVMWRGGSTDYNAAFMSRLNITKDNSKNQ VSLRLSSVTAADTAVYYCAKSMITTGFVMDSWGQ GSLVTTVSS |
| SEQ ID NO: 440 | Cell-targeting molecule 2 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC RASQDVNTAVAWYQQKPGKAPKLLIYSASFLYSGV PSRFSGSRSGTDFTLTISSLQPEDFATYYCQQHYTTP PTFGQGTKVEIKGGGGSGGGGSGGGGSGGGGSGGG GSEVQLVESGGGLVQPGGSLRLSCAASGFNIKDTYI HWVRQAPGKGLEWVARIYPTNGYTRYADSVKGRF TISADTSKNTAYLQMNSLRAEDTAVYYCSRWGGD GFYAMDYWGQGTLVTVSS |
| SEQ ID NO: 441 | Cell-targeting molecule 3 | KEFTLDFSTAKTYVDSLNVIRSAIGTPLQTISSGGTSL LMIDSGSGDNLFAVNLVPMVATVGRFNNLRLIVER NNLYVTGFVNRTNNVFYRFADFSHNTFPGTTAVTL SGDSSYTTLQRVAGISRTGMQINRHSLTTSYLDLMS HSGTSLTQSVARAMLRFVTVTAEALRFRQIQRGFRT TLDDLSGRSYVMTAEDVDLTLNWGRLSSVLPDYHG QDSVRVGRISFGSINAILGSVALILNCHHHASAVAAE FPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGSTSGSGKPGSGEGSTKGQVQLQE SGPGLVRPSQTLSLTCTVSGFSLTSYGVHWVRQPPG RGLEWIGVMWRGGSTDYNAAFMSRLNITKDNSKN QVSLRLSSVTAADTAVYYCAKSMITTGFVMDSWG QGSLVTVSSA |
| SEQ ID NO: 442 | Cell-targeting molecule 4 | KEFTLDFSTAKTYVDSLNVIRSAIGTPLQTISSGGTSL LMIDSGSGDNLFAVNLVPMVATVGRFNNLRLIVERN NLYVTGFVNRTNNVFYRFADFSHNTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASAVAAE FPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGSTSGSGKPGSGEGSTKGQVQLQE SGPGLVRPSQTLSLTCTVSGFSLTSYGVHWVRQPPG RGLEWIGVMWRGGSTDYNAAFMSRLNITKDNSKN QVSLRLSSVTAADTAVYYCAKSMITTGFVMDSWG QGSLVTVSSA |

-continued

Sequence Listing

| ID Number | Text Description | Biological Sequence |
|---|---|---|
| SEQ ID NO: 443 | Cell-targeting molecule 5 | QVQLQQPGAELVKPGASVKMSCKTSGYTFTSYNVH WVKQTPGQGLEWIGAIYPGNGDTFSFNQKFKGKATL TADKSSSTVYMQLSSLTSEDSAVYYCARSNYYGSS YVWFFDGVWGAGTTVTVSSGSTSGSGKPGSGEGSQI VLSQSPTILSASPGEKVTMTCRASSSVSYMDWYQQ KPGSSPKPWIYATSNLASGVPARFSGSGSGTSYSLTI SRVEAEDAATYYCQQWISNPPTFGAGTKLELKEFPK PSTPPGSSGGAPKEFTLDFSTAKTYVDSLNVIRSAIG TPLQTISSGGTSLLMIDSGIGDNLFAVDILGFDFTLGR FNNLRLIVERNNLYVTGFVNRTNNVFYRFADFSHVT FPGTTAVTLSADSSYTTLQRVAGISRTGMQINRHSL TTSYLDLMSHSGTSLTQSVARAMLRFVTVTAEALR FRQIQRGFRTTLDDLSGASYYMTAEDVDLTLNWGR LSSVLPDYHGQDSVRVGRISFGSINAILGSVALILNC HHHASRVAR |
| SEQ ID NO 444 | Cell-targeting molecule 6 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNCHHHASAVAAEF PKPSTPPGSSGGAPQVQLQQPGAELVKPGASVKMS CKTSGYTFTSYNVHWVKQTPGQGLEWIGAIYPGNG DTSFNQKFKGKATLTADKSSSTVYMQLSSLTSEDSA VYYCARSNYYGSSYVWFFDVWGAGTTVTVSSGST SGSGKPGSGEGSQIVLSQSPTILSASPGEKVTMTCRA SSSVSYMDWYQQKPGSSPKPWIYATSNLASGVPAR FSGSGSGTSYSLTISRVEAEDAATYYCQQWISNPPTF GAGTKLELK |
| SEQ ID NO: 445 | Cell-targeting molecule 7 | QVQLQQPGAELVKPGASVKMSCKTSGYTFTSYNVH WVKQTPGQGLEWIGAIYPGNGDTSFNQKFKGKATL TADKSSSTVYMQLSSLTSEDSAVYYCARSNYYGSS YVWFFDVWGAGTTVTVSSGTSGSGKPGSGEGSQI VLSQSPTILSASPGEKVMTCRASSSVSYMDWYQQ KPGSSPKPWIYATSNLASGVPARFSGSGSGTSYSLTI SRVEAEDAATYYCQQWISNPPTFGAGTKLELKEFPK PSTPPGSSGGAPKEFTLDFSTAKTYVDSLNVIRSAIG TPLQTISSGGTSLLMIDSGIGDNLFAVDILGFDFTLGR FNNLRLIVERNNLYVTGFVNRTNNVFYRFADFSHVT FPGTTAVTLSADSSYTTLQRVAGISRTGMQINRHSL TTSYLDLMSHSATSLTQSVARAMLRFVTVTAEALR FRQIQRGFRTTLDDLSGASYVMTAEDVDLTLNWGR LSSVLPDYHGQDSVRVGRISFGSINAILGSVALILNC HHHASRVAR |
| SEQ ID NO: 446 | Cell-targeting molecule 8 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNCHHHASAVAAEF PKPSTPPGSSGGAPQVQLQQPGAELVKPGASVKMS CKTSGYTFTSYNVHWVKQTPGQGLEWIGAIYPGNG DTSFNQKFKGKATLTADKSSSTVYMQLSSLTSEDSA VYYCARSNYYGSSYVWFFDVWGAGTTVTVSSGST SGSGKPGSGEGSQIVLSQSPTILSASPGEKVTMTCRA SSSVSYMDWYQQKPGSSPKPWIYATSNLASGVPAR FSGSGSGTSYSLTISRVEAEDAATYYCQQWISNPPTF GAGTKLELK |
| SEQ ID NO: 447 | Cell-targeting molecule 9 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC RASQGISSWLAWYQQKPEKAPKSLIYAASSLQSGVP SRFSGSGSGTDFTLTISSLQPEDFATYYCQQYNSYPR TFGQGTKVEIKGGGGSQVQLVQSGAEVKKPGSSVK |

-continued

Sequence Listing

| ID Number | Text Description | Biological Sequence |
|---|---|---|
| | | VSCKASGGTFSSYAFSWVRQAPGQGLEWMGRVIPF LGIANSAQKFQGRVTITADKSTSTAYMDLSSLRSED TAVYYCARDDIAALGPFDYWGQGTLVTVSS |
| SEQ ID NO: 448 | Cell-targeting molecule 10 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIVLTQSPASLAVSLGQRATISC RATESVEYYGTSLVQWYQQKPGQPPKLLIYAASSV DSGVPARFSGSGSGTDFSLTHIPVEEDDIAMYFCQQS RRVPYTFGGGTKLEIKGGGGSEVQLQQSGPELVKPG ASVKMSCKASGYTFTSYVMHWVKQKPGQGLEWIG YVNPFNDGTKYNEMFKGKATLTSDKSSSTAYMELS SLTSEDSAVYYCARQAWGYPWGQGTLVTVSA |
| SEQ ID NO: 449 | Cell-targeting molecule 11 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIVLTQSPASLAVSLGQRATISC RATESVEYYGTSLVQWYQQKPGQPPKLLIYAASSV DSGVPARFSGSGSGTDFSLTIHPVEEDDIAMYFCQQS RRVPYTFGGGTKLEIKGGGGSGGGGSGGGGSGGGG SGGGGSEVQLQQSGPELVKPGASVKMSCKASGYTF TSYVMHWVKQKPGQGLEWIGYVNPFNDGTKYNE MFKGKATLTSDKSSSTAYMELSSLTSEDSAVYYCA RQAWGYPWGQGTLVTVSA |
| SEQ ID NO: 450 | Cell-targeting molecule 12 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPEIVLTQSPATLSLSPGERATLSCR ASQSVSSYLAWYQQKPGQAPRLLIYDASNRATGIPA RFSGSGSGTDFTLTISSLEPEDFAVYYCQQRSNWPTF GQGTKVEIKGGGGSGGGGSGGGGSGGGGSGGGGS QVQLVQSGAEVKKPGSSVKVSCKTSGDTFSTYAIS WVRQAPGQGLEWMGGIIPIFGKAHYAQKFQGRVTI TADESTSTAYMELSSLRSEDTAVYFCARKFHFVSGS PFGMDVWGQGTTVTVSS |
| SEQ ID NO: 451 | Cell-targeting molecule 13 | KEFTLDFSTAKTYVDSLNVIRSAIGTPLQTISSGGTSL LMIDSGIGDNLFAVDILGFDFTLGRFNNLRLIVERNN LYVTGFVNRTNNVFYYFRADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPQVQLVQSGAEVKKPGSSVKVSC KTSGDTFSTYAISWVRAPGQGLEWMGGIIPIFGKA HYAQKFQGRVTITADESTSTAYMELSSLRSEDTAVY FCARKFHFVSGSPFGMDVWGQGTTVTVSSGGGGSG GGGSGGGGSGGGGSGGGGSEIVLTQSPATLSLSPGE RATLSCRASQSVSSYLAWYQQKPGQAPRLLIYDAS NRATGIPARFSGSGSGTDFTLTISSLEPEDFAVYYCQ QRSNWPTFGQGTKVEIK |
| SEQ ID NO: 452 | Cell-targeting molecule 14 | KEFTLDFSTAKTYVDSLNVIRSAIGTPLQTISSGGTSL LMIDSGIGDNLFAVDILGFDFTLGRFNNLRLIVFRNN LYVTGFVNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIVLTQSPASLAVSLGQRATISC |

-continued

Sequence Listing

| ID Number | Text Description | Biological Sequence |
|---|---|---|
| | | KASQSVDFDGDSYMNWYQQKPGQPPKVLIYAASN LESGIPARFSGSGSGTDFTLNIHPVEEEDAATYYCQQ SNEDPWTFGGGTKLEIKGGGGSQIQLQQSGPEVVKP GASVKISCKASGYTFTDYYITWVKQKPGQGLEWIG WIYPGSGNTKYNEKFKGKATLTVDTSSSTAFMQLSS LTSEDTAVYFCANYGNYWFAYWGQGTQVTVSA |
| SEQ ID NO: 453 | Cell-targeting molecule 15 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGGGGSQVQLQESGPGLVRPSQTLSL TCTVSGFSLTSYGVHWVRQPPGRGLEWIGVMWRG GSTDYNAAFMSRLNITKDNSKNQVSLRLSSVTAAD TAVYYCAKSMITTGFVMDSWGQGSLVTVSS |
| SEQ ID NO: 454 | Cell-targeting molecule 16 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC RASQDVNTAVAWYQQKPGKAPKLLIYSASFLYSGV PSRFSGSRSGTDFTLTISSLQPEDFAFYYCQQHYTTP PTFGQGTKVEIKGGGGSGGGGSGGGGSGGGGSGGG GSEVQLVESGGGLVQPGGSLRLSCAASGFNIKDTYI HWVRQAPGKGLEWVARIYPTNGYTRYADSVKGRF TISADTSKNTAYLQMNSLRAEDTAVYYCSRWGGD GFYAMDYWGQGTLVTVSS |
| SEQ ID NO: 455 | Cell-targeting molecule 17 | KEFTLDFSTAKTYVDSLNVIRSAIGTPLQTISSGGTSL LMIDSGIGDNLFAVDILGFDFTLGRFNNLRLIVERNN LYVTGFVNRTNNVFVRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHCQ DSVRVGRISFGSINAILGSVALILNSHHHASAVAAEF PKPSTPPGSSGGAPDIVMTQAAPSIPVTPGESVSISCR SSKSLLNSNGNTYLYWFLQRPGQSPQLLIYRMSNLA SGVPDRFSGSGSGTAFTLRISRVEAEDVGVYYCMQ HLEYPFTFGAGTKLELKGSTSGSGKPGSGEGSEVQL QQSGPELIKPGASVKMSCKASGYTFTSYVMHWVKQ KPGQGLEWIGYINPYNDGTKYNEKFKGKATLTSDK SSSTAYMELSSLTSEDSAVYYCARGTYYYGSRVFD YWGQGTTLTVSS |
| SEQ ID NO: 456 | Cell-targeting molecule 18 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTI DDLSGASYVMTAEDVDLTLNWGRLSSVLPDYHGQ DSVRVGRISFGSINAILGSVALILNSHHHASAVAAEF PKPSTPPGSSGGAPDIQMTQTTSSLSASLGDRVTISC RASQDISNYLAWYQQKPDGTVKLLIYYTSILHSGVP SRFSGSGSGTDYSLTISNLEQEDFATYFCQQGNTLP WTFGCGTKLEIKGSTSGSGKPGSGEGSEVQLVESGG GLVKPGGSLKLSCAASGFAFSIYDMSWVRQIPEKC LEWVAYISSGGGTTYYPDTVKGRFTISRDNAKNTLY LQMSSLKSEDTAMYYCARHSGYGTHWGVLFAYW QQGTLVTVSA |
| SEQ ID NO: 457 | Cell-targeting molecule 19 | KEFTLDFSTAKTYVDSLNVIRSAIGTPLQTISSGGTSL LMIDSGIGDNLFAVDIIGFDFTLGRFNNLRLIVERNN LYVTGFVNRTNNVFYRFADFSIFVTFPGTTAVTLSA DSSYTTLQRVAGISRTGMQINRHSLTTSYLDLMSHS GTSLTQSVARAMLRFVTVTAEALRFRQIQRGFRTIL |

-continued

Sequence Listing

| ID Number | Text Description | Biological Sequence |
|---|---|---|
| | | DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNFV TFGQGTKVEIKGSTSGSGKPGSGEGSTKGQVQLQES GPGLVRPSQTLSLTCTVSGFSLTSYGVHWVRQPPGR GLEWIGVMWRGGSTDYNAAFMSRLNITKDNSKNQ VSLRLSSVTAADTAVYYCAKSMITTGFVMDSWGQ GSLVTVSS |
| SEQ ID NO: 458 | Cell-targeting molecule 20 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYITLQRVAGISRIGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIELTQSPSSFSVSLGDRVTITCK ASEDIYNRLAWYQQKPGNAPRLLISGATSLETGVPS RFSGSGSGKDYTLSITSLQTEDVATYYCQQYWSTPT FGGGTKLEIKGSTSGSGKPGSGEGSKVQLQESGPSL VQPSQRLSITCTVSGFSLISYGVHWVRQSPGKGLEW LGVIWRGGSTDYNAAFMSRLSITKDNSKSQVFFKM NSLQADDTAIYFCAKTLITTGYAMDYWGQGTTVTV SS |
| SEQ ID NO: 459 | Cell-targeting molecule 21 | KEFTLDFSTAKTYVDSLNVIRSAIGTPLQTISSGGTSL LMIDSGIGDNLFAVDILGFVFTLGRFNNLRLIVERNN LYVTGFVNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAHDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGGGGSQVQLQESGPGLVRPSQTLSL FCTVSGFSLTSYGVHWVRQPPGRGLEWIGVMWRG GSTDYNAAFMSRLNITKDNSKNQVSLRLSSVTAAD TAVYYCAKSMITTGFVMDSWGQGSLVTVSS |
| SEQ ID NO: 460 | Cell-targeting molecule 22 | KEFTLDFSTAKTYVDSLNVIRSAIGTPLQTISSGGTSL LMIDSGIGDNLFAVDILGFVFTLGRFNNLRLIVERNN LYVTGFYNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC RASQGISSWLAWYQQKPEKAPKSLIYAASSLQSGVP SRFSGSGSGTDFTLTISSLQPEDFATYYCQQYNSYPY TFGQGTKLEIKGGGGSQVQLVQSGAEVKKPGASVK VSCKASGYTFTSYDVHWVRQAPGQRLEWMGWLH ADTGITKFSQKFQGRVTITRDTSASTAYMELSSLRSE DTAVYYCARERIQLWFDYWGQGTLVTVSS |
| SEQ ID NO: 461 | Cell-targeting molecule 23 | KEFTLDFSTAKTYVDSLNVIRSAIGTPLQTISSGGTSL LMIDSGIGDNLFAVDILGFVFTLGRFNNLRLIVERNN LYVTGFVNRTNNVFYRFADFSHVTFPGTTAVTLSA DSSYTTLQRVAGISRTGMQINRHSLTTSYLDLMSFLS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPEVQLVESGGGLVQPGGSLRLSC AASGFTFSDSWIHWVRQAPGKGLEWVAWISPYGGS TYYADSVKGRFTISADTSKNTAYLQMNSLRAEDTA VYYCARRHWPGGFDYWGQGTLVTVSSGGGGSDIQ MTQSPSSLSASVGDRVTITCRASQDVSTAVAWYQQ KPGKAPKLLIYSASFLYSGVPSRFSGSGSGTDFTLTIS SLQPEDFATYYCQQYLYHPATFGQGTKVEIK |
| SEQ ID NO: 462 | Cell-targeting molecule 24 | KEFTLDFSTAKTYVDSLNVIRSAIGTPLQTISSGGTSL LMIDSGIGDNLFAVGILGFDFTLGRFNNLRLIVERNN LYVTGFVNRTNNVFYRFADFSHVTFPGTTAVTLSA |

-continued

Sequence Listing

| ID Number | Text Description | Biological Sequence |
|---|---|---|
| | | DSSYTTLQRVAGISRTGMQINRHSLTTSYLDLMSHS GTSLTQSVARAMLRFVTVTAEALRFRQIQRGFRTTL DDLSCASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGGGGSQVQLQESGPGLVRPSQTLSL TCTVSGFSLTSYGVHWVRQPPGRGLFAVIGVMWRG GSTDYNAAFMSRLNITKDNSKNQVSLRLSSVTAAD TAVYYCAKSMITTGFVMDSWGQGSLVTVSS |
| SEQ ID NO: 463 | Cell-targeting molecule 25 | KEFTLDFSTAKTYVDSLNVIRSAIGTPLQTISSGGTSL LMIDSGIGDNLFAVGILGFDFTLGRFNNLRLIVERNN LYVTGFVNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC RASQGISSWLAWYQQKPEKAPKSLIYAASSLQSGVP SRFSGSGSGTDFTLTISSLQPFDFATATCQQYNSYPY TFGQGTKLEIKGGGGSQVQLVQSGAEVKKPGASVK VSCKASGYTFTSYDVHWVRQAPGQRLEWMGWLH ADTGITKFSQKFQGRVTITRDTSASTAYMELSSLRSE DTAVYYCARFRIQLWFDYWGQGTLVTVSS |
| SEQ ID NO: 464 | Cell-targeting molecule 26 | KEFTLDFSTAKTYVDSLNVIRSAIGTPLQTISSGGTSL LMIDSGIGDNLFAVGILGFDFTLGRFNNLRLIVERNN LYVTGFVNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVAIILNSHHHASAVAAEF PKPSTPPGSSGGAPEVQLVESGGGLVQPGGSLRLSC AASGFTFSDSWIHWVRQAPGKGLEWVAWISPYGGS TYYADSVKGRFTISADTSKNTAYLQMNSLRAEDTA VYYCARRHWPGGFDYWGQGTLVTVSSGGGGSDIQ MTQSPSSLSASVGDRVTITCRASQDVSTAVAWYQQ KPGKAPKLLIYSASFLYSGVPSRFSGSGSGTDFTLTIS SLQPEDFATYYCQQYLYHPATFGQGTKVEIK |
| SEQ ID NO: 465 | Cell-targeting molecule 27 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGGGGSQVQLQESGPGLVRPSQTLSL TCTVSGFSLTSYGVHWVRQPPGRGLEWIGVMWRG GSTDYNAAFMSRLNITKDNSKNQVSLRLSSVTAAD TAVYVCARSMITTGFVMDSWGQGSLVTVSS |
| SEQ ID NO: 466 | Cell-targeting molecule 28 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGSTSGSGKPGSGEGSTKGQVQLQES GPGLVRPSQTLSLTCTVSGFSLTSYGVHWVRQPPGR GLEWIGVMWRGGSTDYNAAFMSRLNITKDNSKNQ VSLRLSSVTAADTAVYYCAKSMITTGFVMDSWQ GSLVTVSSA |

-continued

Sequence Listing

| ID Number | Text Description | Biological Sequence |
|---|---|---|
| SEQ ID NO: 467 | Cell-targeting molecule 29 | KEFTLDFSTAKTYVDSLNVIRSAIGTPLQTISSGGTSL LMIDSGIGDNLFAVDILGFDFTLGRFNNLRLIVFRNN LYVTGFVNRTNNVFYRFADFSHVTFPGTTAVTLSA DSSYTTLQRVAGISRTGMQINRHSLTTSYLDLMSHS ATSLTQSVARAMLRFVTYTAEALRFRQIQRGFRTTL DDLSGRSYVMTAEDVDLTLNWGRLSSVLPDYHGQ DSVRVGRISFGSINAILGSVALILNSFIHHASAVAAEF PKPSTPPGSSGGAPDIQMTQSPSSESASVGDRVTITC RASQDVNTAVAWYQQKPGKAPKLLIYSASFLYSGV PSRFSGSRSGTDFTLTISSLQPEDFAIYYCQQHYTFP PTFGQGTKVEIKRTGSTSGSGKPGSGEGSEVQLVES GGGLVQPGGSLRLSCAASGFNIKDTYIHWVRQAPG KGLEWVARIYPTNGYTRYADSVKGRFTISADTSKN TAYLQMNSLRAEDTAVYYCSRWGGDGFYAMDVW GQGTLVTVSS |
| SEQ ID NO: 468 | Cell-targeting molecule 30 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKFSTPPGSSGGAPDIELTQSPSSFSVSLGDRVTITCK ASEDIYNRLAWYQQKPGNAPRLLISGATSLETGVPS RFSGSGSGKDYTLSITSLQTEDVATYYCQQYWSTPT FGGGTKLEIKGSTSGSGKPGSGEGSKVQLQESGPSL VQPSQRLSITCTVSGFSLISYGVHWVRQSPGKGLEW LGVIWRGGSTDYNAAFMSRLSITKDNSKSQVFFKM NSLQADDTAIYFCAKTLITTGYAMDYWGQGTTVTV SS |
| SEQ ID NO: 469 | Cell-targeting molecule 31 | KEFTLDFSTAKTYVDSLNVIRSAIGTPLQTISSGGTSL LMIDSGIGDNLFAVDILGFDFTLGRFNNLRIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPGSSOGAPDIQMTQSPSSLSASVGDRVTITC RASQDVNTAVAWYQQKPGKAPKLLIYSASFLYSGV PSRFSGSRSGTDFTLTISSLQPEDFATYYCQQHYTTP PTFGQGTKVEIKGGGGSGGGGSGGGGSGGGGSGGG GSEVQLVESGGGLVQPGGSLRLSCAASGFNIKDTYI HWVRQAPGRGLEWVARIYPTNGYTRYADSVKGRF TISADTSKNTAYLQMNSLRAEDTAVYYCSRWGGD GFYAMDYWGQGTLVTVSS |
| SEQ ID NO: 470 | Cell-targeting molecule 32 | KEFTLDFSTAKTYVDSLNVIRSAIGTPLQTISSGGTSL LMIDSGIGDNLFAVDILGFDFTLGRNNLRLIVERNN LYVTGFVNRTNNVFYRFADFSHVTFPGTTAVTLSA DSSYTTLQRVAGISRTGMQWRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPGSSGGAPDIVMTQAAPSIPVTPGESVSISCR SSKSLLNSNGNTYLYWFLQRPGQSPQLLIYRMSNLA SGVPDRFSGSGSGTAFTLRISRVEAEDVGVYYCMQ HLEYPFTFGAGTKLELKGSTSGSGKPGSGEGSEVQL QQSGPELIKPGASVKMSCKASGYTFTSYVMHWVKQ KPGQGLEWIGYINPYNDGTKYNEKFKGKATLTSDK SSSTAYMELSSLTSEDSAVYYCARGTYYYGSRVFD YWGQGTTLTVSS |
| SEQ ID NO: 471 | Cell-targeting molecule 33 | KEFTEDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPGSSGGAPDIQMTQTTSSLSASLGDRVTISC RASQDISNYLAWYQQKPDGTVKLLIYYTSFLHSGVP SRFSGSGSGTDYSLTISNLEQEDFATYFCQQGNTLP WTFGCGTKLEIKGSTSGSGKPGSGEGSEVQLVESGG |

-continued

Sequence Listing

| ID Number | Text Description | Biological Sequence |
|---|---|---|
| | | GLVKPGGSLKLSCAASGFAFSIYDMSWVRQTPEKC LEWVAYISSGGGTTYYPDTVKGRFTISRDNAKNTLY LQMSSLKSEDTAMYYCARHSGYGTHWGVLFAYW GQGTLVTVSA |
| SEQ ID NO: 472 | Cell-targeting molecule 34 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHG DSVRVGRISFGSINAILGSVALILNSHHHASAVAAEF PKPSTPPGSSGGAPDIVLTQSPASLAVSLGQRATISC KASQSVDFDGDSYMNWYQQKPGQPPKVLIYAASN LESGIPARFSGSGSGTDFTLNIHPVEEEDAATYYCQQ SNEDPWTFGGGTKLEIKGGGGSQIQLQQSGPEVVKP GASVKISCKASGYTFTDYYITWVKQKPGQGLEWIG WIYPGSGNTKYNEKFKGKATLTVDTSSSTAFMQLSS LTSEPTAVYFCANYGNYWFAYWGQGTQVTSA |
| SEQ ID NO: 473 | Cell-targeting molecule 35 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPGSSGGAPQITLKESGPGILQPSQTLSLTCSF SGFSLTTYGIGVGWIRQPPGKGLENVLTHIWWNDNK YYNTALRSRLTISKDSSNNQVLLKIANVDTADTATY YCLYGYIYWGQGTLVTVSAGGGGSDVVMTQTPLS LPVSLGDQASISCRSSQSLLYSNGNTYLITWYLQKPG QSPKLLIYKLSNRFSGVPDRFSGSGSGTDFTLKTSRV EAEPLGVYTCSQSTHVPWTFGGGTKLEIK |
| SEQ ID NO: 474 | Cell-targeting molecule 36 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSFIS ATSLTQSVARAMLRFVTVTAEALRFRQIQRGFRTTL DDLSGRSYVMTAEDVDLTLNWGRLSSVLPDYHGQ DSVRVGRISFGSINAILGSVALILINSHHHASAVAAEF PKPSTPPGSSGGAPDIVLTQSPASLAVSLGQRATISC RATESVEYYGTSLVQWYQQKPGQPPKLLIYAASSV DSGVPARFSGSGSGTDFSLTHIPVEEDDIAMYFCQQS RRVPYTFGGGTKLEIKGGGGSEVQLQQSGPELVKPG ASVKMSCKASGYTFTSYVMHWVKQKPGQGLEWIG YVNPFNDGTKYNEMFKGKATLTSDKSSSTAYMELS SLTSEDSAVYYCARQAWGYPWGQGTLVTVSA |
| SEQ ID NO: 475 | Cell-targeting molecule 37 | KEFTLDFSTAKTYVDSLNVIRSAIGTPLQTISSGGTSL LMIDSGIGDNLFAVGILGFVFTLGRFNNLRLIVERNN LYVTGFYNRTNNVFYRFADFSHVTFPGTTAVTLSA DSSYTTLQRVAGISRTGMQINRPISLTTSYLDLMSHS GTSLTQSVARAMLRFVTVTAEALRFRQIQRGFRTTI DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGGGGSQVQLQESGPGLVRPSQTLSL TCTVSGFSLTSYGVHWVRQPPGRGLEWIGVMWRG GSTDYNAAFMSRLNITKDNSKNQVSLRLSSVTAAD TAVYYCAKSMITTGFVMPSWGQGSLVTVSS |
| SEQ ID NO: 476 | Cell-targeting molecule 38 | KEFTLDFSTAKTYVDSLNVIRSAIGTPLQTISSGGTSL LMIDSGIGDNLFAVGILGFVFTLGRFNNLRLIVERNN LYVTGFVNRTNNVFYRFADFSHVTFPGTTAVTLSA DSSYTTLQRVAGISRTGMQINRHSLTTSYLDLMSHS GTSLTQSVARAMLRFVTVTAHALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC RASQGISSWLAWYQQKPEKAPKSLIYAASSLQSGVP SRFSGSGSGTDFTLTISSLQPEDFATYYCQQYNSYPY |

-continued

| Sequence Listing | | |
|---|---|---|
| ID Number | Text Description | Biological Sequence |
| | | TFGQGTKLEIKGGGGSQVQLVQSGAEVKKPGASVK VSCKASGYTFTSYDVHWVRQAPGQRLEWMGWLH ADTGITKFSQKFQGRVTITRDTSASIAYMELSSLRSE DTAVYYCARERIQLWFDYWGQGTLVTVSS |
| SEQ ID NO: 477 | Cell-targeting molecule 39 | KEFTLDFSTAKTYVDSLNVIRSAIGTPLQTISSGGTSL LMIDSGIGDNLFAVGILGFVFTLGRFNNLRLIVERNN LYVTGFVNRTNNVFYRFADFSHVTFPGTTAVTLSA DSSYTTLQRVAGISRTGMQINRHSLTTSYLDLMSHS GTSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPEVQLVESGGGLVQPGGSLRLSC AASGFTFSDSWMWVRQAPGKGLEWVAWISPYGGS TYYADSVKGRFTISADTSKNTAYLQMNSLRAEDTA VYYCARRHWPGGFDYWGQGTLVTVSSGGGGSDTQ MTQSPSSLSASVGPRVTITCRASQDVSTAVAWYQQ KPGKAPKLLIYSASFLYSGVPSRFSGSGSGTDFTLTIS SLQPEDFATYYCQQYLYHPATFGQGTKVEIK |
| SEQ ID NO: 478 | Cell-targeting molecule 40 | AEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHYTFPGTTAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVFIKGGGGSQVQLQESGPGLVRPSQTLSL TCTVSGFSLTSYGVHWVRQPPGRGLEWIGVMWRG GSTDYNAAFMSRLNITKDNSKNQVSLRLSSVTAAD TAVYYCAKSMITTGFVMDSWGQGSLVTVSS |
| SEQ ID NO: 479 | Cell-targeting molecule 41 | AEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC RASQDVNTAVAWTQQKPGKAPKLLIYSASFLYSGV PSRFSGSRSGTDFTLTISSLQPEDFATYYCQQHYTTP PTFGQGTKVEIKGGGGSEVQLVESGGGLVQPGGSL RLSCAASGFNIKDTYIHWVRQAPGKGLEWVARIYP TNGYTRYADSVKGRFTISADTSKNTAYLQMNSLRA EDTAVYYCSRWGGDGFYAMDYWGQGTLVTVSSA |
| SEQ ID NO: 480 | Cell-targeting molecule 42 | KEFTLDFSTAKTYVDSLNVIRSAIGTTLQTISSGGTSL LMIDSGIGDNLFAVDILGFDFTLGRFNNLRLIVERNN LYVTGFVNRTNNVFYRFADFSHVTFPGTTAVTLSG DSSYTTLQRVAGISRTGMQINRHSLTTSYLDLMSHS GTSLTQSVARAMLRFVTVTAEALRFRQIQRGFRGIL GDVFTRSYVMTAEDVDLTLNWGRLSSVLPDYHGQ DSVRVGRISFGSINAILGSVALILNSHHHASAVAAEF PKPSTPFGSSGGAPDIQMTQSPSSLSASVGORVTITC KASEDIYNRLTWYQQKPGKAPKLLISGATSLETGVP SRFSGSGSGTDFTFTISSLQPEDIATYYCQQYWSNPY TFGQGTKVEIKGSTSGSGKPGSGEGSTKGQVQLQES GPGLVRPSQTLSLTCTVSGFSLTSYGVHWVRQPPGR GLEWIGVMWRGGSTDYNAAFMSRLNITKDNSKNQ VSLRLSSVTAADTAVTYCAKSMITTGFVMDSWGQ GSLVTVSS |
| SEQ ID NO: 481 | Cell-targeting molecule 43 | KEFTLDFSTAKTYVDSLNVIRSAIGTPLQTISSGGTSL LMIDSGIGDNLFAVDILGFDFTLGRFNNLRLIVERNN LYYTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP |

-continued

Sequence Listing

| ID Number | Text Description | Biological Sequence |
|---|---|---|
| | | SRFSGSGSGTDFTFTISSLQPEDIATYYCQQYWSNPY TFGQGTKVEIKGSTSGSGKPGSGEGSTKGQVQLQES GPGLVRPSQTLSLTCTVSGFSLTSYGVHWVRQPPGR GLEWIGVMWRGGSTDYNAAFMSRLNITKDNSKNQ VSLRLSSVTAADTAVYYCAKSMITTGFVMDSWGQ GSLVTVSS |
| SEQ ID NO: 482 | Cell-targeting molecule 44 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRIGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSESASVGDRVTITC KASEDIYNRLTWYQQKPGKAPKLLLSGDRSLETGVP SRFSGSGSGTDFTFTISSLQPEDIATYYCQQYWSNPY TFGQGTKVEIKGGGGSQVQLQESGPGLVRPSQTLSL TCTVSGFSLTSYGVRWVRQPPGRGLEWLGVMWRG GSTDYNAAFMSRLNITKDNSKNQVSLRLSSVTAAD TAVYYCAKSMFFFGFVMPSWGQGSLVTVSS |
| SEQ ID NO: 483 | Cell-targeting molecule 45 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPFGSSGGAPDIOMTQSPSSESASVGDRVTITC RASQDVNTAVAWYQQKPGKAPKLLIYSASFLYSGV PSRFSGSRSGTDFTLTISSLQPEDFATYYCQQHYTTP PTFGQGTKVEIKGGGGSGGGGSGGGGSGGGGSGGG GSEVQLVESGGGLVQPGGSLRLSCAASGFNIKDTYI HWVRQAPGKGEEWVARIYPTNGYTRYADSVKGRF TISADTSKNTAYLQMNSLRAEDTAVYYCSRWGGD GFYAMDYWGQGTLVTVSS |
| SEQ ID NO: 484 | Cell-targeting molecule 46 | AEFTLDFSTAKTYVDSLNVIRSAIGTPLQTISSGGTSL LMIDSGIGDNLFAVDILGFDFTLGRFNNLRIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGGGGSQVQLQESGPGLVRPSQTLSL TCTVSGFSLTSYGVHWVRQPPGRGLEWIGVMWRG GSTDYNAAFMSRLNITKDNSKNQVSLRLSSVTAAD TAVYYCAKSMITTGFVMDSWGQGSLVTVSS |
| SEQ ID NO: 485 | Cell-targeting molecule 47 | KEFILDFSTAKYYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTHTC KASEDIYNRLTWYQOKPGKAPKLLISGATSLETGVP SRFSGSGSGTDFTFTISSLQPEDIATYYCQQYWSNPY TFGQGTKVEHKGGGGSQVQLQESGPGLVRPSQTLSE TCTVSGFSLTSYGVHWVRQPPGRGLEWIGVMWRG GSTDYNAAFMSRLNITKDNSKNQVSLRLSSVTAAD TAVYYCAKSMITTGFVMDSWGQGSLVTVSS |
| SEQ ID NO: 486 | Cell-targeting molecule 48 | KEFILDFSTAKTYVDSLNVIRSAIGTPLQTISSGGTSL LMIDSGIGDNLFAVDILGFDFTLGRFNNLRLIVERNN LYVTGFVNRTNNVFYRFADFSITVTFPGTTAVTLSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF |

-continued

Sequence Listing

| ID Number | Text Description | Biological Sequence |
|---|---|---|
| | | PKPSTPPGSSGGAPDIQMTQSPSSLSASVGDRVTITC RASQDVNTAVAWYQQKPGKAPKLLIYSASFLYSGV PSRFSGSRSGTDFTLTISSLQPEDFATYYCQQHYTTP PTFGQGTKVEIKGGGGSEVQLVESGGGLVQPGGSL RLSCAASGFNIKDTYIHWVRQAPGKGLEWVARIYP TNGYTRYADSVKGRFTISADTSKNTAYLQMNSLRA EDTAVYYCSRWGGDGFYAMDYWGQGTLVTVSSA |
| SEQ ID NO: 487 | Cell-targeting molecule 49 | KEFILDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIVLTQSPASLAVSLGQRATISC KASQSVDFDGDSYMNWYQQKPGQPPKVLTYAASN LESGIPARFSGSGSGTDFTLNIHPVEEEDAATYYCQQ SNEDPWTFGGGTKLEIKGGGGSQIQLQQSGPEVVKP GASVKISCKASGYFFTDYYITWVKQKPGQGLEWIG WIYPGSGNTKYNEKFKGKATLTVDTSSSTAFMQLSS LTSEDTAVYFCANYGNYWFAYWGQGTQVTVSA |
| SEQ ID NO: 488 | Cell-targeting molecule 50 | KEFILDFSTAKIYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIVMTQAAPSIPVTPGESVSISCR SSKSLLNSNGNTYLYWFLQRPGQSPQLLIYRMSNLA SGVPDRFSGSGSGTAFTLRISRVEAEDVGVYYCMQ HLEYPFTFGAGTKLEEKGSTSGSGKPGSGEGSEVQL QQSGPELIKPGASVKMSCKASGYTFTSYVMHWVKQ KPGQGLEWIGYINPYNDGTKYNEKFKGKATLTSDK SSSTAYMELSSLTSEDSAVYYCARGTYYYGSRVFD VWGQGTTLTVSS |
| SEQ ID NO: 489 | Cell-targeting molecule 51 | QVQLQQPGAELVKPGASVKMSCKTSGYTFTSYNVH WVKQTPGQGLEWIGAIYPGNGDTSFNQKFKGKATL TADKSSSTVYMQLSSLTSEDSAVYYCARSNYYGSS YVWFFDVWGAGTTVTVSSGSTSGSGKPGSGEGSQI VLSQSPTILSASPGEKVTMTCRASSSVSYMDWYQQ KPGSSPKPWTYATSNLASGVPARFSGSGSGTSYSLTI SRVEAEDAAIYYCQQWISNPPTFGAGTKLELKEFPK PSTPPGSSGGAPKEFILDFSTAKTYVDSLNVIRSAIGT PLQTISSGGTSLLMIDSGIGDNLFAVDILGEDFILGRF NNLRLIVERNNLYVTGFVNRTNNVFYRFADFSHVTF PGTTAVTLSADSSYTTLQRVAGISRTGMQINRHSLT TSYLDLMSHSATSLTQSVARAMLRFVTVTAEALRF RQIQRGFRTTLDDLSGASYVMTAEDVDLTLNVVGRL SSVLPDYHGQDSVRVGRISFGSINAILGSVALILNSH HHASAVAA |
| SEQ ID NO: 490 | Cell-targeting molecule 52 | KEFILDFSTAKTYVDSLNVIRSAIGTPLQTISSGGTSL LMIDSGIGDNLFAVDILGFDFTLGRFNNLRLIVERNN LYVTGFVNRTNNVFYRFADFSHVIFPGITAVILSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQTTSSLSASLGDRVTISC RASQDISNYLAWYQQKPDGTVKLLIYYTSILHSGVP SRFSGSGSGTDYSLTISNLEQEDFATYFCQQGNTLP WTFGCGTKLEIKGSTSGSGKPGSGEGSEVQLVESGG GLVKPGGSLKLSCAASGFAFSIYDMSWVRQTPEKC LEWVAYISSGGGTIYYPDTVKGRFTISRDNAKNTLY LQMSSLKSEDTAMYYCARHSGYGTHWGVLFAYW GQGTLVTVSA |
| SEQ ID NO: 491 | Cell-targeting molecule 53 | KEFILDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS |

-continued

Sequence Listing

| ID Number | Text Description | Biological Sequence |
|---|---|---|
| | | ATSLTQSVARAMLRFVTVTAEALRFRQIQRGFRTTL DDLSGASYVMTAEDVDLTLNWGRLSSVLPDYHGQ DSVRVGRISFGSINAILGSVALtLNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGSTSGSGKPGSGEGSTKGQVQLQES GPGLVRPSQTLSLTCTVSGFSLTSYGVHWVRQPPGR GLEWIGVMWRGGSTDYMAAFMSRLNITKDNSKNQ VSLRLSSVTAADTAVYYCAKSMITTGFVMDSWGQ GSLVTVSS |
| SEQ ID NO: 492 | Cell-targeting molecule 54 | KEFILDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIELTQSPSSFSVSLGDRVTITCK ASEDIYNRLAWYQQKPGNAPRLLISGATSLETGVPS RFSGSGSGKDYTLSITSLQTEDVATYYCQQYWSTPT FGGGTKLEIKGSTSGSGKPGSGEGSKVQLQESGPSL VQPSQRLSITCTVSGFSLISYGVHWVRQSPGKGLEW LGVIWRGGSTDYNAAFMSRLSITKDNSKSQVFFKM NSLQADDTAIYFCAKTLITTGYAMDYWGQGTTVTV SS |
| SEQ ID NO: 493 | Cell-targeting molecule 55 | KEFILDFSTAKTYVDSLNVIRSAIGTPLQTISSGGTSL LMIDSGIGDNLFAVDILGFDFTLGRFNNLRLIVERNN LYVTGFVNRTNNVFYRFADFSWVTFPGTTAVTLSA DSSYTTLQRVAGISRTGMQINRHSLTISYLDLMSHS ATSLTQSVARAMLRFVTVTAEALRFRQIQRGFRTFL DDLSGASYVMTAEDVDLTLNWGRLSSVLPDYHGQ DSVRVGRISFGSINAILGSVALILNSHHHASAVAAEF PKPSTPPGSSGGAPQITLKFSGPGILQPSQTLSLTCSF SGFSLTTYGIGVGWIRQPPGKGLEWLTHIWWNDNK VYNTALRSRLTISKDSSNNQVLLKIANVDTADTATY YCLYGYTYWGQGTLVTVSAGGGGSDVVMTQTPLS LPVSLGDQASISCRSSQSLLYSNGNTYLHWYLQKPG QSPKLLIYKLSNRFSGVPDRFSGSGSGTDFTLKISRV EAEDLGVYFCSQSTHVPWTFGGGTKLEIK |
| SEQ ID NO: 494 | Cell-targeting molecule 56 | KEFILDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC RASQDVNTAVAWYQQKPGKAPKLLIYSASFLYSGV PSRFSGSRSGTDFTLTISSLQPEDFATYYCQQHYTTP PTFGQGTKVEIKGGGGSGGGGSGGGGSGGGGSGGG GSEVQLVESGGGLVQPGGSLRLSCAASGFNIKDTYI HWVRQAPGKGLEWVARIYPTNGYTRYADSVKGRF TISADTSKNTAYLQMNSLRAEDTAVYYCSRWGGD GFYAMDYWGQGTLVTVSS |
| SEQ ID NO: 495 | Cell-targeting molecule 57 | KEFILDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRCFRTTL DDLSGASYVMTAEDVDLTLNWGRLSSVLPDYHGQ DSVRVGRISFGSINAILGSVALILNSHHHASAVAAEF PKPSTPPGSSGGAPDIVLTQSPASLAVSLGQRATISC RATESVEYYGTSLVQWYQQKPGQPPKLLIYAASSV DSGVPARFSGSGSGTDFSLTIHPVEEDDIAMYFGQQS RRVPYTFGGGTKLEIKGGGGSEVQLQQSGPELVKPG ASVKMSCKASGYTFTSYVMHWVKQKPGQGLEWIG YVNPFNDGTKYNEMFKGKATLTSDKSSSTAYMELS SLTSEDSAVYYCARQAWGYPWGQGTLVTVSA |

-continued

| Sequence Listing | | |
|---|---|---|
| ID Number | Text Description | Biological Sequence |
| SEQ ID NO: 496 | Cell-targeting molecule 58 | AEFILDFSTAKTYVDSLNVIRSAIGTPLQTISSGGTSL LMIDSGIGDNLFAVDILGFDFTLGRFNNLRLIVERNN LYVTGFVNRTNNVFYRFADFSWVTFPGTTAVTLSA DSSYTTLQRVAGISRTGMQINRHSLTTSYLDLMSHS ATSLTQSVARAMLRFVTVTAEALRFRQIQRGFRTFL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPRLLISGATSLETGVP SRFSGSGSGTDFTFTISSLQPEDIATYYCQQYWSNPY TTGQGTKVEIKGGGGSQVQLQESGPGLVRPSQTLSL TCTVSGFSLTSYGVHWVRQPPGRGLEWIGVMWRG GSTDYNAAFMSRLNITKDNSKNQVSLRLSSVTAAD TAVYYCAKSMITTGFVMPSWGQGSLVTVSS |
| SEQ ID NO: 497 | Cell-targeting molecule 59 | AEFILDFSTAKTYVDSLNVIRSAIGTPIQTISSGGTSL LMIDSGIGDNLFAVNLVPMVATVGRFNNLRLIVERN NLYVTGFVNRTNNVFYRFADFSHVTFPGTTAVTLS ADSSYTTLQRVAGISRTGMQINRHSLTTSYLDLMS SATSLTQSVARAMLRFVTVTAEALRFRQIQRGFRTT LDDLSGASYVMTAEDVDLTLNWGRLSSVLPDYHG QDSVRVGRISFGSINAILGSVALILNSHHHASAVAAE FPKPSTPPGSSGGAPDIQMTQSPSSLSASVGDRVTIF CKASEDIYNRLTWYQQKPGKAPKLLISGATSLETGV PSRFSGSGSGTDFTFTISSLQPEDIATYYCQQYWSNP YTFGQGTKVEIKGGGGSQVQLQESGPGLVRPSQTLS LTCTVSGFSLTSYGVHWVROPPGRGLEWIGVMWR GGSTDYNAAFMSRLNITKDNSKNQVSLRLSSVTAA DTAVYYCAKSMITTGFVMDSWGQGSLVTVSS |
| SEQ ID NO: 498 | Cell-targeting molecule 60 | KEFILDFSTAKTYVDSLNVIRSAIGTPLQTISSGGTSL LMIDSGIGDNLFAVDVRGIAPIEARFNNLRLIVERNN LYVTGFVNRTNNVFYRFADFSHVTFPGYYAVYLSA DSSYTTLQRVAGISRTGMQINRHSLTTSYLDLMSHS ATSLTQSVARAMLRFVTVTAEALRFRQIQRGFRTTL AALSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTYTC KASEDIYNRLTWYQQKPGKAPKLLISGATSLETGVP SRFSGSGSGTDFTFTISSLQPEDLATYYCQQYWSNPY TFGQGTKVEIKGGGGSQVQLQESGPGLVRPSQTLSL TCTVSGFSLTSYGVHWVRQPPGRGLEWIGVMWRG GSTDYNAAFMSRLNITKDNSKNQVSLRLSSVTAAD TAVYYCAKSMITTGFVMDSWGQGSLVTVSS |
| SEQ ID NO: 499 | Cell-targeting molecule 61 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRLADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHARNLATMV ATVASAVAAEFPKPSTPPGSSGGAPDIQMTQSPSSLS ASVGDRVTITCKASEDIYNRLTWYQQKPGKAPKLLI SGATSLETGVPSRFSGSGSGTDFTFTISSLQPEDIATY YCQQYWSNPYTFGQGTKVEIKGGGGSQVQLQESGP GLVRPSQTLSLTCTVSGFSLTSYGVHWVRQPPGRGL EWIGVMWGGSTDYNAAFMSRLNITKDNSKNQVS LRLSSVTAADTAVYYCAKSMITTGPVMDSWGQGSL VTVSS |
| SEQ ID NO: 500 | Cell-targeting molecule 62 | KEFTLDFSTAKTYVDSLNVIRSAIGTPLQTISSGGTSL LMIDSGSGDNLFAVDILGFDFTLGRFNNLRLIVERN NLYVTGFVNRTNNVFYRFADFSHVTFPGTTAVTLS GDSSYTTLQRVAGISRTGMQINRHSLTTSYLDLMSH SGTSLTQSVARAMLRFVTVTAEALRFRQIQRGFRTT LDDLSGRSYVMTAEDVDLTLNWGRLSSVLPDYHG QDSVRVGRISFGSINAILGSVALILNCHHHASAVAAE FPKPSTPPGSSGGAPDIQMTQSPSSLSASVGDRVTIT CKASEDIYNRIYWYQQKPGKAPKLLISGATSLETGV PSRFSGSGSGTDFTFTISSLQPEDIATYYCQQYWSNP YTFGQGTKVEIKGGGGSQVQLQESGPGLVRPSQTLS LTCTVSGFSLTSYGVHWVRQPPGRGLEWIGVMWR GGSTDYNAAFMSRLNITKDNSKNQVSLRLSSVTAA DTAVYYCAKSMITTGFVMDSWGOGSLVTVSS |

-continued

Sequence Listing

| ID Number | Text Description | Biological Sequence |
|---|---|---|
| SEQ ID NO: 501 | Cell-targeting molecule 63 | KEFTLDFSTAKTYVDSLNVIRSAIGTPLQTISSGGTSL LMIDSGSGDNLFAVDVRGIAPEEGRFNNLRLIVERN NLYVTGFVNRTNNVFYRFADFSHVTFPGTTAVTLS ADSSYTTLQRVAGISRTGMQINORHSLTTSYLDLMSH SATSLTQSVARAMLRFVTVTAEALRFRQIQRGFRTT LDDLSGASYVMTAEDVDLTLNWGRLSSVLPDYHG QDSVRVGRISFGSINAILGSVALILNSHHHASAVAAE FPKPSTPPGSSGGAPDIQMTQSPSSLSASVGDRVTIT CKASEDIYNRLTWYQQKPGKAPKLLISGATSLETGV PSRFSGSGSGTDFTFTISSLQPEDIATYYCQQYWSNP YTFGQGTKVEIKGSTSGSGKPGSGEGSTKGQVQLQE SGPGLVRPSQTLSLTCTVSGFSLTSYGVHWVRQPPG RGLEWIGVMWRGGSTDYNAAFMSRLNITKDNSKN QVSLRLSSVTAADTAVYYCAKSMITTGFVMDSWG QGSLVTVSSA |
| SEQ ID NO: 502 | Cell-targeting molecule 64 | AFFTLDFSTAKTYVDSLNVIRSAIGTPLQTISSGGTSL LMIDSGIGDNLFAVDILGFDFTLGRFNNLRLIVFRNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSMHHASAVAAEF PKPSTPPGSSGGAPDVQVTQSPSSLSASVGDRVTITC RSSQSLANSYGNTFLSWYLHKPGKAPQLLIYGISNR FSGVPDRFSGSGSGTDFTLTISSLQPEDFATYYCLQG THQPYTFGQGTKVEIKGGGGSEVQLVQSGAEVKKP GASVKVSCKASGYRFTNYWIHWVRQAPGQGLEWI GGINPGNNYATYRRKFQGRVTMTADTSTSTVYMEL SSLRSEDTAVYYCTREGYGNYGAWFAYWGQGTLV TVSSA |
| SEQ ID NO: 503 | Cell-targeting molecule 65 | AEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTIAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPGSSGGAPDIVLTQSPASLAVSLGQRATISC KASQSVDFDGDSYMNWYQQKPGQPPKVLIYAASN LESGIPARFSGSGSGTDFTLNIHPVEEEDAATYYCQQ SNEDPWTFGGGTKLEIKGGGGSQIQLQQSGPEVVKP GASVKISCKASGYTFTDYYITWVKQKPGQGLEWIG WIYPGSGNTKYNEKFKGKATITVDTSSSTAFMQLSS LTSEDTAVYFCANYGNYWFAYWGQGTQVTVSA |
| SEQ ID NO: 504 | Cell-targeting molecule 66 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSMS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPCSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGGGGSQVQLQESGPGEVRPSQTLSL TCTVSGFSLTSYGVHWVRQPPGRGLEWIGVMWRG GSTDYNAAFMSRLNITKDNSKNQVSLRLSSVTAAD TAVYYCAKSMITTGFVMDSWGQGSLVTVSSA |
| SEQ ID NO: 505 | Cell-targeting molecule 67 | KEFILDFSTAKTYVDSLNVIRSAIGTPLQTISSGGTSL LMIDSGIGDNLFAVDVRGIAPIEARFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL AAESGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGGGGSQVQLQESGPGLVRPSQTLSL |

-continued

| Sequence Listing | | |
|---|---|---|
| ID Number | Text Description | Biological Sequence |
| | | TCTVSGFSLTSYGVHWVRQPPGRGLEWIGVMWRG GSIDYNAAFMSRLNITKDNSKNQVSLRLSSVTAAD TAVYYCAKSMITTGFVMDSWGQGSLVTVSSA |
| SEQ ID NO: 506 | Cell-targeting molecule 68 | KEFILDFSTAKEYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGGGGSQVQLQESGPGLVRPSQTLSL TCTVSGFSLTSYGVHWVRQPPGRGLEWIGVMWRG GSTDYNAAFMSRLNITKDNSKNQVSLRLSSVTAAD TAVYYCAKSMITTGFVMDSWGQGSLVTVSSA |
| SEQ ID NO: 507 | Cell-targeting molecule 69 | AEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRFISLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTTTISSLQPEDIATYYCQQYWSNPY TFGQGTKVEIKGGGGSQVQLQESGPGLVRPSQTESL TCTVSGFSLTSYGVHWVRQPPGRGLEWIGVMWRG GSTDYNAAFMSRLNITKDNSKNQVSLRLSSVTAAD TAVYYCAKSMITTGFVMDSWGQGSLVTVSSA |
| SEQ ID NO: 508 | Cell-targeting molecule 70 | AEFILDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIWMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGGGGSQVQLQESGPGLVRPSQTLSL TCTVSGFSLTSYGVHWVRQPPGRGLEWIGVMWRG GSTDYNAAFMSRLNITKDNSKNQVSLRLSSVTAAD TAVYYCAKSMITTGFVMDSWGQGSLVTVSSA |
| SEQ ID NO: 509 | Cell-targeting molecule 71 | KEFTLDFSTAKTYVDSLNVIRSAIGTPLQTISSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGRSYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTTTC KASEDIYNRLTWYQQKPGKAPKLLISGATSLETGVP SRFSGSGSGTDFTFTISSLQPEDIATYYCQQYWSNPY TFGQGTKVEIKGGGGSQVQLQESGPGLVRPSQTLSL TCTVSGFSLTSYGVHWVRQPPGRGLEWIGVMWRG GSTDYNAAFMSRLNITKDNSKNQVSLRLSSVTAAD TAVYYCARSMITTGFVMDSWGOGSLVTVSSA |
| SEQ ID NO: 510 | Cell-targeting molecule 73 | KEFILDFSTAKTYVDSLNVIRSAIGTPLQTFSSGGTSL LMIDSGIGDNLFAVDILGFDFTLGRFNNLRLIVERNN LYVTGFVNRTNNVFYRFADFSHVTFPGTTAVTLSA DSSYTTLQRVAGISRTGMQINRHSLTTSYLDLMSHS ATSLTQSVARAMLRFVTVTAEALRFRQIQRGFRTTL DDLSGASYVMTAEDVDLTLNWGRLSSVLPDYHGQ DSVRVGRISFGSINAILGSVALILNSHHHASAVAAEF PKPSTPPGSSGGAPDIQMTQSPSSLSASVGDRVTITC KASEDIYNRLTWYQQKPGKAPKLLISGATSLETGVP SRFSGSGSGTDFTFTISSLQPEDIATYYCQQYWSNPY TFGQGTKVEIKGGGGSQVQLQESGPGLVRPSQTLSL |

-continued

Sequence Listing

| ID Number | Text Description | Biological Sequence |
|---|---|---|
| | | TCTVSGFSLTSYGVHWVRQPPGRGLEWIGVMWRG<br>GSTDYNAAFMSRLNITKDNSKNQVSLRLSSVTAAL<br>FAVYYCAKSMITTGFVMDSWGQGSLVTVSSA |
| SEQ ID NO: 511 | Cell-targeting molecule 74 | AEFTLDFSTAKIYVDSLNVIRSAIGTPLQTISSGGTSL<br>LMIDSGIGDNLFAVDILGFDFTLGRFNNLRLIVERNN<br>LYVTGFVNRTNNVFYRFADFSHVTFPGTTAVTLSA<br>DSSYTTLQRVAGISRTGMQINRHSLTTSYLDLMSHS<br>ATSLTQSVARAMLRFVTVTAEALRFRQIQRGFRTTL<br>DDLSGRSYVMTAEDVDLTLNWGRLSSVLPDYHGQ<br>DSVRVGRISFGSINAILGSVALILNSHHHASAVAAEF<br>PKPSTPPGSSGGAPDIQMTQSPSSLSASVGDRVTITC<br>RASQDVNTAVAWYQQKPGKAPKLLIYSASFLYSGV<br>PSRFSGSRSGTDFTLTISSLQPEDFATYYCQQHYTTP<br>PTFGQGTKVEIKGGGGSKVQLVESGGGLVQPGGSL<br>RLSCAASGFNIKDTYIHWVRQAPGKGLEWVARIYP<br>TNGYTRYADSVKGRFTISADTSKNTAYLQMNSLRA<br>EDTAVTYCSRWGGDGFYANIDYWGQGTLVTVSSA |
| SEQ ID NO: 512 | Cell-targeting molecule 75 | AEFTLDFSTAKTYVDSLNVIRSAIGTPLQTISSGGTSL<br>LMIDSGIGDNLFAVDILGFDFTLGRFNNLRLIVERNN<br>LYVTGFVNRTNNVFYRFADFSHVTFPGTTAVTLSA<br>DSSYTTLQRVAGISRTGMQINRHSLTTSYLDEMSHS<br>ATSLTQSVARAMLRFVTVTAEALRFRQIQRGFRTTL<br>DDLSGRSYVMFAEDVDLILNWGRLSSVLPDYHGQ<br>DSVRVGRISFGSINAILGSVALILNSHHHASAVAAEF<br>PKPSTPPGSSGGAPAIQMSQSPASLSASVGETVTITC<br>RASGNTYNYLAWYQQKQGKSPITLLVYDAKTLADG<br>VPSRFSGSGSGTQYSLKISSLQTEDSGNYYCQHFWS<br>LPFTFGSGTKLEIKGSTSGSGKPGSGEGSTKGEVQLQ<br>QSGAELVRPGALVKLSCKTSGFNIKDYFLHWVRQR<br>PDQGLEWIGWINPDNGNTVYDPKFQGTASLTADTS<br>SNTVYLQLSGLTSEDTAVYFCTRRDYTYEKAALDY<br>WGQGTTVTVST |
| SEQ ID NO: 513 | Cell-targeting molecule 76 | AEFTLDFSTAKTYVDSLNVIRSAIGTPLQTISSGGTSL<br>LMIDSGIGDNLFAVDILGFDFTLGRFNNLRLIVERNN<br>LYVTGFVNRTNNVFYRFADFSHVTFPGTTAVTLSA<br>DSSYTTLQRVAGISRTGMQINRHSLTTSYLDLMSHS<br>ATSLTQSVARAMLRFVTVTAEALRFRQIQRGFRTTL<br>DDLSGRSYVMTAEDVDLTLNWGRLSSVLPDYHGQ<br>DSVRVGRISFGSINAILGSVALILNSHHHASAVAAEF<br>PKPSTPPGSSGGAPDIQLTQSPLSLPVTLGQPASISCR<br>SSQSLVHRNGNTYLHWFQQRPGQSPRLLIYTVSNRF<br>SGVPDRFSGSGSGTDFTLKISRVEAEDVGVYFCSQSS<br>HVPPTFGAGTRLEIKGSTSGSGKPGSGEGSTKGQVQ<br>LQQSGSELKKPGASVKVSCKASGYTFTNYGVNWIK<br>QAPGQGLQWMGWINPNTGEPTFDDDFKGRFAFSLD<br>TSVSTAYLQISSLKADDTAVYFCSRSRGKNEAWFA<br>YWGQGTLVTVSS |

SEQUENCE LISTING (594 sequences)

SEQ ID NO: 1 - protein, 293 aa, Escherichia coli
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 2 - protein, 293 aa, Shigella dysenteriae
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 3 - protein, 297 aa, Escherichia coli
DEFTVDFSSQKSYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQKQKTECQIVGDRAAIKVNNVLWEANTIAALLNRKPQDLTEPNQ

SEQ ID NO: 4 - protein, 251 aa, Shigella dysenteriae
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 5 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 6 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTNLVPMVATVSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 7 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 8 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 9 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVNLVPMVATVGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 10 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 11 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 12 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 13 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 14 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFVFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 15 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 16 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 17 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFVFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 18 - protein, 251 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAA

SEQ ID NO: 19 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRGILGDVFTRSYVMTAEDVDLTLNWGRLSSVLPDYHGQDSVRVGRISFGSINAILGSVALILNSHHHASAVAA

SEQ ID NO: 20 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 21 - protein, 251 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 22 - protein, 251 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 23 - protein, 251 aa, Artificial Sequence
  source: /note="Description of Artificial Sequence: Synthetic polypeptide"
AEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 24 - protein, 251 aa, Artificial Sequence
  source: /note="Description of Artificial Sequence: Synthetic polypeptide"
AEFILDFSTAKTYVDSLNVIRSAIGTPLQTISSGGTSLLMIDSGIGDNLFAVNLVPMVATVGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 25 - protein, 251 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDVRGIAPIEARFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLAALSGASYVMTAEDVDLTLNWGRLSSVLPDYHGQDSVRVGRISFGSINAILGSVALILNSHHHASAVAA

SEQ ID NO: 26 - protein, 262 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHARNLVPMVATVASAVAA

SEQ ID NO: 27 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 28 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 29 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 30 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 31 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 32 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 33 - protein, 512 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 34 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 35 - protein, 513 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 36 - protein, 521 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSA

SEQ ID NO: 37 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 38 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 39 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 40 - protein, 513 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQTTSSLSASLGDRVTISCRASQDISNYLAWYQQKPDGTVKLLIYYTSILHSGVPSRFSGSGSGTDYSLTISNLEQEDFATYFCQQGNTLPWTFGCGTKLEIKGSTSGSGKPGSGEGSEVQLVESGGGLVKPGGSLKLSCAASGFAFSIYDMSWVRQTPEKCLEWVAYISSGGGTTYYPDTVKGRFTISRDNAKNTLYLQMSSLKSEDTAMYYCARHSGYGTHWGVLFAYWGQGTLVTVSA

SEQ ID NO: 41 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSS

SEQ ID NO: 42 - protein, 508 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAREFPKPSTPPGSSGGAPDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSS

SEQ ID NO: 43 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 44 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 45 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFVFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 46 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVGILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 47 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 48 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVGILGFVFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 49 - protein, 499 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 50 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 51 - protein, 499 aa, Artificial Sequence
  source: /note="Description of Artificial Sequence: Synthetic polypeptide"
MAEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 52 - protein, 499 aa, Artificial Sequence
  source: /note="Description of Artificial Sequence: Synthetic polypeptide"
MKEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 53 - protein, 499 aa, Artificial Sequence
  source: /note="Description of Artificial Sequence: Synthetic polypeptide"
MAEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 54 - protein, 499 aa, Artificial Sequence
  source: /note="Description of Artificial Sequence: Synthetic polypeptide"
MAEFILDFSTAKTYVDSLNVIRSAIGTPLQTISSGGTSLLMIDSGIGDNLFAVNLVPMVATVGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 55 - protein, 499 aa, Artificial Sequence
  source: /note="Description of Artificial Sequence: Synthetic polypeptide"
MKEFILDFSTAKTYVDSLNVIRSAIGTPLQTISSGGTSLLMIDSGIGDNLFAVDVRGIAPIEARFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLAALSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 56 - protein, 510 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHARNLVPMVATVASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 57 - protein, 513 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTNLVPMVATVSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 58 - protein, 512 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 59 - protein, 513 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVNLVPMVATVGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 60 - protein, 513 aa, Artificial Sequence
  source: /note="Description of Artificial Sequence: Synthetic polypeptide"
MKEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 61 - protein, 513 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 62 - protein, 512 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRGILGDVFTRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 63 - protein, 513 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 64 - protein, 512 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 65 - protein, 512 aa, Artificial Sequence
  source: /note="Description of Artificial Sequence: Synthetic polypeptide"
MQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 66 - protein, 520 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 67 - protein, 520 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 68 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 69 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFVFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 70 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVGILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 71 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVGILGFVFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 72 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 73 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFVFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 74 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVGILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 75 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNATNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 76 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 77 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 78 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 79 - protein, 498 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 80 - protein, 513 aa, Artificial Sequence
  source: /note="Description of Artificial Sequence: Synthetic polypeptide"
MKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTNLVPMVATVSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQTTSSLSASLGDRVTISCRASQDISNYLAWYQQKPDGTVKLLIYYTSILHSGVPSRFSGSGSGTDYSLTISNLEQEDFATYFCQQGNTLPWTFGCGTKLEIKGSTSGSGKPGSGEGSEVQLVESGGGLVKPGGSLKLSCAASGFAFSIYDMSWVRQTPEKCLEWVAYISSGGGTTYYPDTVKGRFTISRDNAKNTLYLQMSSLKSEDTAMYYCARHSGYGTHWGVLFAYWGQGTLVTVSA

SEQ ID NO: 81 - protein, 499 aa, Artificial Sequence
  source: /note="Description of Artificial Sequence: Synthetic polypeptide"
MKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 82 - protein, 499 aa, Artificial Sequence; identical to SEQ ID NO: 44
  source: /note="Description of Artificial Sequence: Synthetic polypeptide"

SEQ ID NO: 83 - protein, 9 aa, Artificial Sequence
  source: /note="Description of Artificial Sequence: Synthetic peptide"
YTFTSYVMH

SEQ ID NO: 84 - protein, 14 aa, Artificial Sequence
  source: /note="Description of Artificial Sequence: Synthetic peptide"
WIGYINPYNDGTKY

SEQ ID NO: 85 - protein, 13 aa, Artificial Sequence
  source: /note="Description of Artificial Sequence: Synthetic peptide"
RGTYYYGSRVFDY

SEQ ID NO: 86 - protein, 13 aa, Artificial Sequence
  source: /note="Description of Artificial Sequence: Synthetic peptide"
KSLLNSNGNTYLY

SEQ ID NO: 87 - protein, 11 aa, Artificial Sequence
  source: /note="Description of Artificial Sequence: Synthetic peptide"
LLIYRMSNLAS

SEQ ID NO: 88 - protein, 8 aa, Artificial Sequence
  source: /note="Description of Artificial Sequence: Synthetic peptide"
MQHLEYPF

SEQ ID NO: 89 - protein, 9 aa, Artificial Sequence
  source: /note="Description of Artificial Sequence: Synthetic peptide"
YAFSSYWMN

SEQ ID NO: 90 - protein, 14 aa, Artificial Sequence
  source: /note="Description of Artificial Sequence: Synthetic peptide"
WIGQIWPGDGDTNY

SEQ ID NO: 91 - protein, 16 aa, Artificial Sequence
  source: /note="Description of Artificial Sequence: Synthetic peptide"
RRETTTVGRYYYAMDY

SEQ ID NO: 92 - protein, 12 aa, Artificial Sequence
  source: /note="Description of Artificial Sequence: Synthetic peptide"
QSVDYDGDSYLN

SEQ ID NO: 93 - protein, 11 aa, Artificial Sequence
  source: /note="Description of Artificial Sequence: Synthetic peptide"
LLIYDASNLVS

SEQ ID NO: 94 - protein, 8 aa, Artificial Sequence
  source: /note="Description of Artificial Sequence: Synthetic peptide"
QQSTEDPW

SEQ ID NO: 95 - protein, 16 aa, Artificial Sequence
  source: /note="Description of Artificial Sequence: Synthetic peptide"
WIGQIWPGDGDTNYNG

SEQ ID NO: 96 - protein, 11 aa, Artificial Sequence
  source: /note="Description of Artificial Sequence: Synthetic peptide"
GSISTSGMGVG

SEQ ID NO: 97 - protein, 13 aa, Artificial Sequence
  source: /note="Description of Artificial Sequence: Synthetic peptide"
WIGHIWWDDDKRY

SEQ ID NO: 98 - protein, 11 aa, Artificial Sequence
  source: /note="Description of Artificial Sequence: Synthetic peptide"
RMELWSYYFDY

SEQ ID NO: 99 - protein, 7 aa, Artificial Sequence
  source: /note="Description of Artificial Sequence: Synthetic peptide"
SSVSYMH

SEQ ID NO: 100 - protein, 11 aa, Artificial Sequence
  source: /note="Description of Artificial Sequence: Synthetic peptide"
LLIYDTSKLAS

SEQ ID NO: 101 - protein, 8 aa, Artificial Sequence
  source: /note="Description of Artificial Sequence: Synthetic peptide"
FQGSVYPF

SEQ ID NO: 102 - protein, 10 aa, Artificial Sequence
  source: /note="Description of Artificial Sequence: Synthetic peptide"
GYTFTSYNMH

SEQ ID NO: 103 - protein, 17 aa, Artificial Sequence
  source: /note="Description of Artificial Sequence: Synthetic peptide"
AIYPGNGDTSYNQKFKG

SEQ ID NO: 104 - protein, 12 aa, Artificial Sequence
  source: /note="Description of Artificial Sequence: Synthetic peptide"
AQLRPNYWYFDV

SEQ ID NO: 105 - protein, 10 aa, Artificial Sequence
  source: /note="Description of Artificial Sequence: Synthetic peptide"
RASSSVSYMH

SEQ ID NO: 106 - protein, 7 aa, Artificial Sequence
  source: /note="Description of Artificial Sequence: Synthetic peptide"
ATSNLAS

SEQ ID NO: 107 - protein, 9 aa, Artificial Sequence
  source: /note="Description of Artificial Sequence: Synthetic peptide"
QQWISNPPT

SEQ ID NO: 108 - protein, 10 aa, Artificial Sequence
  source: /note="Description of Artificial Sequence: Synthetic peptide"
GYTFTSYNVH

SEQ ID NO: 109 - protein, 14 aa, Artificial Sequence
  source: /note="Description of Artificial Sequence: Synthetic peptide"
SNYYGSSYVWFFDV

SEQ ID NO: 110 - protein, 10 aa, Artificial Sequence
  source: /note="Description of Artificial Sequence: Synthetic peptide"
RASSSVSYMD

SEQ ID NO: 111 - protein, 12 aa, Artificial Sequence
  source: /note="Description of Artificial Sequence: Synthetic peptide"
STYYGGDWYFNV

SEQ ID NO: 112 - protein, 10 aa, Artificial Sequence
  source: /note="Description of Artificial Sequence: Synthetic peptide"
RASSSVSYIH

SEQ ID NO: 113 - protein, 9 aa, Artificial Sequence
  source: /note="Description of Artificial Sequence: Synthetic peptide"
QQWTSNPPT

SEQ ID NO: 114 - protein, 10 aa, Artificial Sequence
  source: /note="Description of Artificial Sequence: Synthetic peptide"
GFTFNDYAMH

SEQ ID NO: 115 - protein, 17 aa, Artificial Sequence
  source: /note="Description of Artificial Sequence: Synthetic peptide"
TISWNSGSIGYADSVKG

SEQ ID NO: 116 - protein, 13 aa, Artificial Sequence
  source: /note="Description of Artificial Sequence: Synthetic peptide"
DIQYGNYYYGMDV

SEQ ID NO: 117 - protein, 11 aa, Artificial Sequence
  source: /note="Description of Artificial Sequence: Synthetic peptide"
RASQSVSSYLA

SEQ ID NO: 118 - protein, 7 aa, Artificial Sequence
  source: /note="Description of Artificial Sequence: Synthetic peptide"
DASNRAT

SEQ ID NO: 119 - protein, 9 aa, Artificial Sequence
  source: /note="Description of Artificial Sequence: Synthetic peptide"
QQRSNWPIT

SEQ ID NO: 120 - protein, 10 aa, Artificial Sequence
  source: /note="Description of Artificial Sequence: Synthetic peptide"
GYTFTSYNMH

SEQ ID NO: 121 - protein, 13 aa, Artificial Sequence
  source: /note="Description of Artificial Sequence: Synthetic peptide"
VVYYSNSYWYFDV

SEQ ID NO: 122 - protein, 7 aa, Artificial Sequence
  source: /note="Description of Artificial Sequence: Synthetic peptide"
APSNLAS

SEQ ID NO: 123 - protein, 9 aa, Artificial Sequence
  source: /note="Description of Artificial Sequence: Synthetic peptide"
QQWSFNPPT

SEQ ID NO: 124 - protein, 10 aa, Artificial Sequence
  source: /note="Description of Artificial Sequence: Synthetic peptide"
GYAFSYSWIN

SEQ ID NO: 125 - protein, 17 aa, Artificial Sequence
  source: /note="Description of Artificial Sequence: Synthetic peptide"
RIFPGDGDTDYNGKFKG

SEQ ID NO: 126 - protein, 10 aa, Artificial Sequence
  source: /note="Description of Artificial Sequence: Synthetic peptide"
NVFDGYWLVY

SEQ ID NO: 127 - protein, 16 aa, Artificial Sequence
  source: /note="Description of Artificial Sequence: Synthetic peptide"
RSSKSLLHSNGITYLY

SEQ ID NO: 128 - protein, 7 aa, Artificial Sequence
  source: /note="Description of Artificial Sequence: Synthetic peptide"
QMSNLVS

SEQ ID NO: 129 - protein, 9 aa, Artificial Sequence
  source: /note="Description of Artificial Sequence: Synthetic peptide"
AQNLELPYT

SEQ ID NO: 130 - protein, 9 aa, Artificial Sequence
  source: /note="Description of Artificial Sequence: Synthetic peptide"
YRFTNYWIH

SEQ ID NO: 131 - protein, 16 aa, Artificial Sequence
  source: /note="Description of Artificial Sequence: Synthetic peptide"
WIGGINPGNNYATYRR

SEQ ID NO: 132 - protein, 14 aa, Artificial Sequence
  source: /note="Description of Artificial Sequence: Synthetic peptide"
TREGYGNYGAWFAY

SEQ ID NO: 133 - protein, 13 aa, Artificial Sequence
  source: /note="Description of Artificial Sequence: Synthetic peptide"
QSLANSYGNTFLS

SEQ ID NO: 134 - protein, 11 aa, Artificial Sequence
  source: /note="Description of Artificial Sequence: Synthetic peptide"
LLIYGISNRFS

SEQ ID NO: 135 - protein, 8 aa, Artificial Sequence
  source: /note="Description of Artificial Sequence: Synthetic peptide"
LQGTHQPY

SEQ ID NO: 136 - protein, 9 aa, Artificial Sequence
  source: /note="Description of Artificial Sequence: Synthetic peptide"
FAFSIYDMS

SEQ ID NO: 137 - protein, 14 aa, Artificial Sequence
  source: /note="Description of Artificial Sequence: Synthetic peptide"
WVAYISSGGGTTYY

SEQ ID NO: 138 - protein, 15 aa, Artificial Sequence
  source: /note="Description of Artificial Sequence: Synthetic peptide"
RHSGYGTHWGVLFAY

SEQ ID NO: 139 - protein, 8 aa, Artificial Sequence
  source: /note="Description of Artificial Sequence: Synthetic peptide"
QDISNYLA

SEQ ID NO: 140 - protein, 11 aa, Artificial Sequence
  source: /note="Description of Artificial Sequence: Synthetic peptide"
LLIYYTSILHS

SEQ ID NO: 141 - protein, 8 aa, Artificial Sequence
  source: /note="Description of Artificial Sequence: Synthetic peptide"
QQGNTLPW

SEQ ID NO: 142 - protein, 9 aa, Artificial Sequence
  source: /note="Description of Artificial Sequence: Synthetic peptide"
YTFTSYWLH

SEQ ID NO: 143 - protein, 14 aa, Artificial Sequence
  source: /note="Description of Artificial Sequence: Synthetic peptide"
WIGYINPRNDYTEY

SEQ ID NO: 144 - protein, 8 aa, Artificial Sequence
  source: /note="Description of Artificial Sequence: Synthetic peptide"
RRDITTFY

SEQ ID NO: 145 - protein, 14 aa, Artificial Sequence
  source: /note="Description of Artificial Sequence: Synthetic peptide"
QSVLYSANHKNYLA

SEQ ID NO: 146 - protein, 11 aa, Artificial Sequence
  source: /note="Description of Artificial Sequence: Synthetic peptide"
LLIYWASTRES

SEQ ID NO: 147 - protein, 7 aa, Artificial Sequence
  source: /note="Description of Artificial Sequence: Synthetic peptide"
HQYLSSW

SEQ ID NO: 148 - protein, 9 aa, Artificial Sequence
  source: /note="Description of Artificial Sequence: Synthetic peptide"
YEFSRSWMN

SEQ ID NO: 149 - protein, 18 aa, Artificial Sequence
  source: /note="Description of Artificial Sequence: Synthetic peptide"
WVGRIYPGDGDTNYSGKF

SEQ ID NO: 150 - protein, 12 aa, Artificial Sequence
  source: /note="Description of Artificial Sequence: Synthetic peptide"
RDGSSWDWYFDV

SEQ ID NO: 151 - protein, 13 aa, Artificial Sequence
  source: /note="Description of Artificial Sequence: Synthetic peptide"
QSIVHSVGNTFLE

SEQ ID NO: 152 - protein, 11 aa, Artificial Sequence
  source: /note="Description of Artificial Sequence: Synthetic peptide"
LLIYKVSNRFS

SEQ ID NO: 153 - protein, 8 aa, Artificial Sequence
  source: /note="Description of Artificial Sequence: Synthetic peptide"
FQGSQFPY

SEQ ID NO: 154 - protein, 10 aa, Artificial Sequence
  source: /note="Description of Artificial Sequence: Synthetic peptide"
GYRFTNYWIH

SEQ ID NO: 155 - protein, 17 aa, Artificial Sequence
  source: /note="Description of Artificial Sequence: Synthetic peptide"
GINPGNNYATYRRKFQG

SEQ ID NO: 156 - protein, 12 aa, Artificial Sequence
  source: /note="Description of Artificial Sequence: Synthetic peptide"
EGYGNYGAWFAY

SEQ ID NO: 157 - protein, 16 aa, Artificial Sequence
  source: /note="Description of Artificial Sequence: Synthetic peptide"
RSSQSLANSYGNTFLS

SEQ ID NO: 158 - protein, 7 aa, Artificial Sequence
  source: /note="Description of Artificial Sequence: Synthetic peptide"
GISNRFS

SEQ ID NO: 159 - protein, 9 aa, Artificial Sequence
  source: /note="Description of Artificial Sequence: Synthetic peptide"
LQGTHQPYT

SEQ ID NO: 160 - protein, 10 aa, Artificial Sequence
  source: /note="Description of Artificial Sequence: Synthetic peptide"
GFAFSIYDMS

SEQ ID NO: 161 - protein, 17 aa, Artificial Sequence
  source: /note="Description of Artificial Sequence: Synthetic peptide"
YISSGGGTTYYPDTVKG

SEQ ID NO: 162 - protein, 14 aa, Artificial Sequence
  source: /note="Description of Artificial Sequence: Synthetic peptide"
HSGYGTHWGVLFAY

SEQ ID NO: 163 - protein, 11 aa, Artificial Sequence
  source: /note="Description of Artificial Sequence: Synthetic peptide"
RASQDISNYLA

SEQ ID NO: 164 - protein, 7 aa, Artificial Sequence
  source: /note="Description of Artificial Sequence: Synthetic peptide"
YTSILHS

SEQ ID NO: 165 - protein, 9 aa, Artificial Sequence
  source: /note="Description of Artificial Sequence: Synthetic peptide"
QQGNTLPWT

SEQ ID NO: 166 - protein, 10 aa, Artificial Sequence
  source: /note="Description of Artificial Sequence: Synthetic peptide"
GYTFTDYYIT

SEQ ID NO: 167 - protein, 15 aa, Artificial Sequence
  source: /note="Description of Artificial Sequence: Synthetic peptide"
WIYPGSGNTKYNEKF

SEQ ID NO: 168 - protein, 8 aa, Artificial Sequence
  source: /note="Description of Artificial Sequence: Synthetic peptide"
YGNYWFAY

SEQ ID NO: 169 - protein, 15 aa, Artificial Sequence
  source: /note="Description of Artificial Sequence: Synthetic peptide"
KASQSVDFDGDSYMN

SEQ ID NO: 170 - protein, 7 aa, Artificial Sequence
  source: /note="Description of Artificial Sequence: Synthetic peptide"
AASNLES

SEQ ID NO: 171 - protein, 9 aa, Artificial Sequence
  source: /note="Description of Artificial Sequence: Synthetic peptide"
QQSNEDPWT

SEQ ID NO: 172 - protein, 9 aa, Artificial Sequence
  source: /note="Description of Artificial Sequence: Synthetic peptide"
YTFTTYWMH

SEQ ID NO: 173 - protein, 14 aa, Artificial Sequence
  source: /note="Description of Artificial Sequence: Synthetic peptide"
WIGYINPSTGYTDY

SEQ ID NO: 174 - protein, 16 aa, Artificial Sequence
  source: /note="Description of Artificial Sequence: Synthetic peptide"
TRRGPSYGNHGAWFPY

SEQ ID NO: 175 - protein, 8 aa, Artificial Sequence
  source: /note="Description of Artificial Sequence: Synthetic peptide"
ENVDTYVS

SEQ ID NO: 176 - protein, 11 aa, Artificial Sequence
  source: /note="Description of Artificial Sequence: Synthetic peptide"
LLIYGASNRYT

SEQ ID NO: 177 - protein, 8 aa, Artificial Sequence
  source: /note="Description of Artificial Sequence: Synthetic peptide"
GQSYRYPP

SEQ ID NO: 178 - protein, 10 aa, Artificial Sequence
  source: /note="Description of Artificial Sequence: Synthetic peptide"
GYTFTGYYMH

SEQ ID NO: 179 - protein, 15 aa, Artificial Sequence
  source: /note="Description of Artificial Sequence: Synthetic peptide"
WIDPNSGATTYAQKF

SEQ ID NO: 180 - protein, 11 aa, Artificial Sequence
  source: /note="Description of Artificial Sequence: Synthetic peptide"
KTTQTTWGFPF

SEQ ID NO: 181 - protein, 11 aa, Artificial Sequence
  source: /note="Description of Artificial Sequence: Synthetic peptide"
RASQGVYQWLA

SEQ ID NO: 182 - protein, 7 aa, Artificial Sequence
  source: /note="Description of Artificial Sequence: Synthetic peptide"
KASHLYN

SEQ ID NO: 183 - protein, 9 aa, Artificial Sequence
  source: /note="Description of Artificial Sequence: Synthetic peptide"
QQLNSYPLT

SEQ ID NO: 184 - protein, 10 aa, Artificial Sequence
  source: /note="Description of Artificial Sequence: Synthetic peptide"
GYTFTDYWMH

SEQ ID NO: 185 - protein, 14 aa, Artificial Sequence
  source: /note="Description of Artificial Sequence: Synthetic peptide"
WIGYINPNTAYTDY

SEQ ID NO: 186 - protein, 11 aa, Artificial Sequence
  source: /note="Description of Artificial Sequence: Synthetic peptide"
KASENVDSFVS

SEQ ID NO: 187 - protein, 7 aa, Artificial Sequence
  source: /note="Description of Artificial Sequence: Synthetic peptide"
GASNRYT

SEQ ID NO: 188 - protein, 9 aa, Artificial Sequence
  source: /note="Description of Artificial Sequence: Synthetic peptide"
GQNYRYPLT

SEQ ID NO: 189 - protein, 9 aa, Artificial Sequence
  source: /note="Description of Artificial Sequence: Synthetic peptide"
FSLISYGVH

SEQ ID NO: 190 - protein, 13 aa, Artificial Sequence
  source: /note="Description of Artificial Sequence: Synthetic peptide"
WLGVIWRGGSTDY

SEQ ID NO: 191 - protein, 12 aa, Artificial Sequence
  source: /note="Description of Artificial Sequence: Synthetic peptide"
KTLITTGYAMDY

SEQ ID NO: 192 - protein, 8 aa, Artificial Sequence
  source: /note="Description of Artificial Sequence: Synthetic peptide"
EDIYNRLA

SEQ ID NO: 193 - protein, 12 aa, Artificial Sequence
  source: /note="Description of Artificial Sequence: Synthetic peptide"
LLISGATSLETG

SEQ ID NO: 194 - protein, 7 aa, Artificial Sequence
  source: /note="Description of Artificial Sequence: Synthetic peptide"
QQYWSTP

SEQ ID NO: 195 - protein, 9 aa, Artificial Sequence
  source: /note="Description of Artificial Sequence: Synthetic peptide"
FTFNSFAMS

SEQ ID NO: 196 - protein, 14 aa, Artificial Sequence
  source: /note="Description of Artificial Sequence: Synthetic peptide"
WVSAISGSGGGTYY

SEQ ID NO: 197 - protein, 14 aa, Artificial Sequence
  source: /note="Description of Artificial Sequence: Synthetic peptide"
KDKILWFGEPVFDY

SEQ ID NO: 198 - protein, 8 aa, Artificial Sequence
  source: /note="Description of Artificial Sequence: Synthetic peptide"
QSVSSYLA

SEQ ID NO: 199 - protein, 11 aa, Artificial Sequence
  source: /note="Description of Artificial Sequence: Synthetic peptide"
LLIYDASNRAT

SEQ ID NO: 200 - protein, 8 aa, Artificial Sequence
  source: /note="Description of Artificial Sequence: Synthetic peptide"
QQRSNWPP

SEQ ID NO: 201 - protein, 9 aa, Artificial Sequence
  source: /note="Description of Artificial Sequence: Synthetic peptide"
FSLTSYGVH

SEQ ID NO: 202 - protein, 13 aa, Artificial Sequence
  source: /note="Description of Artificial Sequence: Synthetic peptide"
WIGVMWRGGSTDY

SEQ ID NO: 203 - protein, 12 aa, Artificial Sequence
  source: /note="Description of Artificial Sequence: Synthetic peptide"
KSMITTGFVMDS

SEQ ID NO: 204 - protein, 8 aa, Artificial Sequence
  source: /note="Description of Artificial Sequence: Synthetic peptide"
EDIYNRLT

SEQ ID NO: 205 - protein, 11 aa, Artificial Sequence
  source: /note="Description of Artificial Sequence: Synthetic peptide"
LLISGATSLET

SEQ ID NO: 206 - protein, 8 aa, Artificial Sequence
  source: /note="Description of Artificial Sequence: Synthetic peptide"
QQYWSNPY

SEQ ID NO: 207 - protein, 9 aa, Artificial Sequence
  source: /note="Description of Artificial Sequence: Synthetic peptide"
FDFSRSWMN

SEQ ID NO: 208 - protein, 14 aa, Artificial Sequence
  source: /note="Description of Artificial Sequence: Synthetic peptide"
WIGEINPDSSTINY

SEQ ID NO: 209 - protein, 8 aa, Artificial Sequence
  source: /note="Description of Artificial Sequence: Synthetic peptide"
RYGNWFPY

SEQ ID NO: 210 - protein, 8 aa, Artificial Sequence
  source: /note="Description of Artificial Sequence: Synthetic peptide"
QNVDTNVA

SEQ ID NO: 211 - protein, 11 aa, Artificial Sequence
  source: /note="Description of Artificial Sequence: Synthetic peptide"
ALIYSASYRYS

SEQ ID NO: 212 - protein, 8 aa, Artificial Sequence
  source: /note="Description of Artificial Sequence: Synthetic peptide"
QQYDSYPL

SEQ ID NO: 213 - protein, 9 aa, Artificial Sequence
  source: /note="Description of Artificial Sequence: Synthetic peptide"
GTFSSYAFS

SEQ ID NO: 214 - protein, 14 aa, Artificial Sequence
  source: /note="Description of Artificial Sequence: Synthetic peptide"
WMGRVIPFLGIANS

SEQ ID NO: 215 - protein, 12 aa, Artificial Sequence
  source: /note="Description of Artificial Sequence: Synthetic peptide"
RDDIAALGPFDY

SEQ ID NO: 216 - protein, 8 aa, Artificial Sequence
  source: /note="Description of Artificial Sequence: Synthetic peptide"
QGISSWLA

SEQ ID NO: 217 - protein, 11 aa, Artificial Sequence
  source: /note="Description of Artificial Sequence: Synthetic peptide"
SLIYAASSLQS

SEQ ID NO: 218 - protein, 8 aa, Artificial Sequence
  source: /note="Description of Artificial Sequence: Synthetic peptide"
QQYNSYPR

SEQ ID NO: 219 - protein, 9 aa, Artificial Sequence
  source: /note="Description of Artificial Sequence: Synthetic peptide"
YTFTDYWMQ

SEQ ID NO: 220 - protein, 14 aa, Artificial Sequence
  source: /note="Description of Artificial Sequence: Synthetic peptide"
WIGTIYPGDGDTGY

SEQ ID NO: 221 - protein, 12 aa, Artificial Sequence
  source: /note="Description of Artificial Sequence: Synthetic peptide"
RGDYYGSNSLDY

SEQ ID NO: 222 - protein, 8 aa, Artificial Sequence
  source: /note="Description of Artificial Sequence: Synthetic peptide"
QDVSTVVA

SEQ ID NO: 223 - protein, 11 aa, Artificial Sequence
  source: /note="Description of Artificial Sequence: Synthetic peptide"
RLIYSASYRYI

SEQ ID NO: 224 - protein, 8 aa, Artificial Sequence
  source: /note="Description of Artificial Sequence: Synthetic peptide"
QQHYSPPY

SEQ ID NO: 225 - protein, 10 aa, Artificial Sequence
  source: /note="Description of Artificial Sequence: Synthetic peptide"
GFSLTSYGVH

SEQ ID NO: 226 - protein, 16 aa, Artificial Sequence
  source: /note="Description of Artificial Sequence: Synthetic peptide"
VMWRGGSTDYNAAFMS

SEQ ID NO: 227 - protein, 11 aa, Artificial Sequence
  source: /note="Description of Artificial Sequence: Synthetic peptide"
SMITTGFVMDS

SEQ ID NO: 228 - protein, 11 aa, Artificial Sequence
  source: /note="Description of Artificial Sequence: Synthetic peptide"
KASEDIYNRLT

SEQ ID NO: 229 - protein, 7 aa, Artificial Sequence
  source: /note="Description of Artificial Sequence: Synthetic peptide"
GATSLET

SEQ ID NO: 230 - protein, 9 aa, Artificial Sequence
  source: /note="Description of Artificial Sequence: Synthetic peptide"
QQYWSNPYT

SEQ ID NO: 231 - protein, 10 aa, Artificial Sequence
  source: /note="Description of Artificial Sequence: Synthetic peptide"
GFSLISYGVH

SEQ ID NO: 232 - protein, 16 aa, Artificial Sequence
  source: /note="Description of Artificial Sequence: Synthetic peptide"
VIWRGGSTDYNAAFMS

SEQ ID NO: 233 - protein, 11 aa, Artificial Sequence
  source: /note="Description of Artificial Sequence: Synthetic peptide"
TLITTGYAMDY

SEQ ID NO: 234 - protein, 11 aa, Artificial Sequence
  source: /note="Description of Artificial Sequence: Synthetic peptide"
KASEDIYNRLA

SEQ ID NO: 235 - protein, 7 aa, Artificial Sequence
  source: /note="Description of Artificial Sequence: Synthetic peptide"
GATSLET

SEQ ID NO: 236 - protein, 8 aa, Artificial Sequence
  source: /note="Description of Artificial Sequence: Synthetic peptide"
QQYWSTPT

SEQ ID NO: 237 - protein, 10 aa, Artificial Sequence
  source: /note="Description of Artificial Sequence: Synthetic peptide"
GFDFSRSWMN

SEQ ID NO: 238 - protein, 17 aa, Artificial Sequence
  source: /note="Description of Artificial Sequence: Synthetic peptide"
EINPDSSTINYTTSLKD

SEQ ID NO: 239 - protein, 7 aa, Artificial Sequence
  source: /note="Description of Artificial Sequence: Synthetic peptide"
YGNWFPY

SEQ ID NO: 240 - protein, 11 aa, Artificial Sequence
  source: /note="Description of Artificial Sequence: Synthetic peptide"
KASQNVDTNVA

SEQ ID NO: 241 - protein, 7 aa, Artificial Sequence
  source: /note="Description of Artificial Sequence: Synthetic peptide"
SASYRYS

SEQ ID NO: 242 - protein, 9 aa, Artificial Sequence
  source: /note="Description of Artificial Sequence: Synthetic peptide"
QQYDSYPLT

SEQ ID NO: 243 - protein, 9 aa, Artificial Sequence
  source: /note="Description of Artificial Sequence: Synthetic peptide"
FDFSRYWMS

SEQ ID NO: 244 - protein, 14 aa, Artificial Sequence
  source: /note="Description of Artificial Sequence: Synthetic peptide"
WIGEINPTSSTINF

SEQ ID NO: 245 - protein, 13 aa, Artificial Sequence
  source: /note="Description of Artificial Sequence: Synthetic peptide"
RGNYYRYGDAMDY

SEQ ID NO: 246 - protein, 12 aa, Artificial Sequence
  source: /note="Description of Artificial Sequence: Synthetic peptide"
KSVSTSGYSYLH

SEQ ID NO: 247 - protein, 11 aa, Artificial Sequence
  source: /note="Description of Artificial Sequence: Synthetic peptide"
LLIYLASNLES

SEQ ID NO: 248 - protein, 8 aa, Artificial Sequence
  source: /note="Description of Artificial Sequence: Synthetic peptide"
QHSRELPF

SEQ ID NO: 249 - protein, 9 aa, Artificial Sequence
  source: /note="Description of Artificial Sequence: Synthetic peptide"
STFTTYWIH

SEQ ID NO: 250 - protein, 14 aa, Artificial Sequence
  source: /note="Description of Artificial Sequence: Synthetic peptide"
WIGYINPNTGYTEY

SEQ ID NO: 251 - protein, 9 aa, Artificial Sequence
  source: /note="Description of Artificial Sequence: Synthetic peptide"
VRFITVVGG

SEQ ID NO: 252 - protein, 9 aa, Artificial Sequence
  source: /note="Description of Artificial Sequence: Synthetic peptide"
SSVSSSHLH

SEQ ID NO: 253 - protein, 11 aa, Artificial Sequence
  source: /note="Description of Artificial Sequence: Synthetic peptide"
LWIYSTSNLAS

SEQ ID NO: 254 - protein, 8 aa, Artificial Sequence
  source: /note="Description of Artificial Sequence: Synthetic peptide"
HQYHRSPL

SEQ ID NO: 255 - protein, 11 aa, Artificial Sequence
  source: /note="Description of Artificial Sequence: Synthetic peptide"
FSLTTYGIGVG

SEQ ID NO: 256 - protein, 13 aa, Artificial Sequence
  source: /note="Description of Artificial Sequence: Synthetic peptide"
WLTHIWWNDNKYY

SEQ ID NO: 257 - protein, 5 aa, Artificial Sequence
  source: /note="Description of Artificial Sequence: Synthetic peptide"
YGYTY

SEQ ID NO: 258 - protein, 13 aa, Artificial Sequence
  source: /note="Description of Artificial Sequence: Synthetic peptide"
QSLLYSNGNTYLH

SEQ ID NO: 259 - protein, 11 aa, Artificial Sequence
  source: /note="Description of Artificial Sequence: Synthetic peptide"
LLIYKLSNRFS

SEQ ID NO: 260 - protein, 8 aa, Artificial Sequence
  source: /note="Description of Artificial Sequence: Synthetic peptide"
SQSTHVPW

SEQ ID NO: 261 - protein, 9 aa, Artificial Sequence
  source: /note="Description of Artificial Sequence: Synthetic peptide"
FNIKDTYIH

SEQ ID NO: 262 - protein, 14 aa, Artificial Sequence
  source: /note="Description of Artificial Sequence: Synthetic peptide"
WVARIYPTNGYTRY

SEQ ID NO: 263 - protein, 12 aa, Artificial Sequence
  source: /note="Description of Artificial Sequence: Synthetic peptide"
RWGGDGFYAMDY

SEQ ID NO: 264 - protein, 8 aa, Artificial Sequence
  source: /note="Description of Artificial Sequence: Synthetic peptide"
QDVNTAVA

SEQ ID NO: 265 - protein, 11 aa, Artificial Sequence
  source: /note="Description of Artificial Sequence: Synthetic peptide"
LLIYSASFLYS

SEQ ID NO: 266 - protein, 8 aa, Artificial Sequence
  source: /note="Description of Artificial Sequence: Synthetic peptide"
QQHYTTPP

SEQ ID NO: 267 - protein, 12 aa, Artificial Sequence
  source: /note="Description of Artificial Sequence: Synthetic peptide"
RWGGDGFYAMDV

SEQ ID NO: 268 - protein, 9 aa, Artificial Sequence
  source: /note="Description of Artificial Sequence: Synthetic peptide"
YSFTSYWIA

SEQ ID NO: 269 - protein, 14 aa, Artificial Sequence
  source: /note="Description of Artificial Sequence: Synthetic peptide"
YMGLIYPGDSDTKY

SEQ ID NO: 270 - protein, 21 aa, Artificial Sequence
  source: /note="Description of Artificial Sequence: Synthetic peptide"
RHDVGYCSSSNCAKWPEYFQH

SEQ ID NO: 271 - protein, 10 aa, Artificial Sequence
  source: /note="Description of Artificial Sequence: Synthetic peptide"
SSNIGNNYVS

SEQ ID NO: 272 - protein, 11 aa, Artificial Sequence
  source: /note="Description of Artificial Sequence: Synthetic peptide"
LLIYGHTNRPA

SEQ ID NO: 273 - protein, 10 aa, Artificial Sequence
  source: /note="Description of Artificial Sequence: Synthetic peptide"
AAWDDSLSGW

SEQ ID NO: 274 - protein, 9 aa, Artificial Sequence
  source: /note="Description of Artificial Sequence: Synthetic peptide"
YPFTNYGMN

SEQ ID NO: 275 - protein, 14 aa, Artificial Sequence
  source: /note="Description of Artificial Sequence: Synthetic peptide"
WMGWINTSTGESTF

SEQ ID NO: 276 - protein, 11 aa, Artificial Sequence
  source: /note="Description of Artificial Sequence: Synthetic peptide"
RWEVYHGYVPY

SEQ ID NO: 277 - protein, 8 aa, Artificial Sequence
  source: /note="Description of Artificial Sequence: Synthetic peptide"
QDVYNAVA

SEQ ID NO: 278 - protein, 11 aa, Artificial Sequence
  source: /note="Description of Artificial Sequence: Synthetic peptide"
LLIYSASSRYT

SEQ ID NO: 279 - protein, 8 aa, Artificial Sequence
  source: /note="Description of Artificial Sequence: Synthetic peptide"
QQHFRTPF

SEQ ID NO: 280 - protein, 9 aa, Artificial Sequence
  source: /note="Description of Artificial Sequence: Synthetic peptide"
ITFSINTMG

SEQ ID NO: 281 - protein, 14 aa, Artificial Sequence
  source: /note="Description of Artificial Sequence: Synthetic peptide"
LVALISSIGDTYYA

SEQ ID NO: 282 - protein, 12 aa, Artificial Sequence
  source: /note="Description of Artificial Sequence: Synthetic peptide"
KRFRTAAQGTDY

SEQ ID NO: 283 - protein, 10 aa, Artificial Sequence
  source: /note="Description of Artificial Sequence: Synthetic peptide"
GFNIKDTYIH

SEQ ID NO: 284 - protein, 17 aa, Artificial Sequence
  source: /note="Description of Artificial Sequence: Synthetic peptide"
RIYPTNGYTRYADSVKG

SEQ ID NO: 285 - protein, 11 aa, Artificial Sequence
  source: /note="Description of Artificial Sequence: Synthetic peptide"
WGGDGFYAMDY

SEQ ID NO: 286 - protein, 11 aa, Artificial Sequence
  source: /note="Description of Artificial Sequence: Synthetic peptide"
RASQDVNTAVA

SEQ ID NO: 287 - protein, 7 aa, Artificial Sequence
  source: /note="Description of Artificial Sequence: Synthetic peptide"
SASFLYS

SEQ ID NO: 288 - protein, 9 aa, Artificial Sequence
  source: /note="Description of Artificial Sequence: Synthetic peptide"
QQHYTTPPT

SEQ ID NO: 289 - protein, 10 aa, Artificial Sequence
  source: /note="Description of Artificial Sequence: Synthetic peptide"
GFNIKDTYIH

SEQ ID NO: 290 - protein, 17 aa, Artificial Sequence
  source: /note="Description of Artificial Sequence: Synthetic peptide"
RIYPTNGYTRYADSVKG

SEQ ID NO: 291 - protein, 11 aa, Artificial Sequence
  source: /note="Description of Artificial Sequence: Synthetic peptide"
WGGDGFYAMDV

SEQ ID NO: 292 - protein, 11 aa, Artificial Sequence
  source: /note="Description of Artificial Sequence: Synthetic peptide"
RASQDVNTAVA

SEQ ID NO: 293 - protein, 7 aa, Artificial Sequence
  source: /note="Description of Artificial Sequence: Synthetic peptide"
SASFLYS

SEQ ID NO: 294 - protein, 9 aa, Artificial Sequence
  source: /note="Description of Artificial Sequence: Synthetic peptide"
QQHYTTPPT

SEQ ID NO: 295 - protein, 10 aa, Artificial Sequence
  source: /note="Description of Artificial Sequence: Synthetic peptide"
GYSFTSYWIA

SEQ ID NO: 296 - protein, 17 aa, Artificial Sequence
  source: /note="Description of Artificial Sequence: Synthetic peptide"
LIYPGDSDTKYSPSFQG

SEQ ID NO: 297 - protein, 20 aa, Artificial Sequence
  source: /note="Description of Artificial Sequence: Synthetic peptide"
HDVGYCSSSNCAKWPEYFQH

SEQ ID NO: 298 - protein, 13 aa, Artificial Sequence
  source: /note="Description of Artificial Sequence: Synthetic peptide"
SGSSSNIGNNYVS

SEQ ID NO: 299 - protein, 7 aa, Artificial Sequence
  source: /note="Description of Artificial Sequence: Synthetic peptide"
GHTNRPA

SEQ ID NO: 300 - protein, 11 aa, Artificial Sequence
  source: /note="Description of Artificial Sequence: Synthetic peptide"
AAWDDSLSGWV

SEQ ID NO: 301 - protein, 10 aa, Artificial Sequence
  source: /note="Description of Artificial Sequence: Synthetic peptide"
GITFSINTMG

SEQ ID NO: 302 - protein, 16 aa, Artificial Sequence
  source: /note="Description of Artificial Sequence: Synthetic peptide"
LISSIGDTYYADSVKG

SEQ ID NO: 303 - protein, 10 aa, Artificial Sequence
  source: /note="Description of Artificial Sequence: Synthetic peptide"
FRTAAQGTDY

SEQ ID NO: 304 - protein, 9 aa, Artificial Sequence
  source: /note="Description of Artificial Sequence: Synthetic peptide"
FTFSDSWIH

SEQ ID NO: 305 - protein, 14 aa, Artificial Sequence
  source: /note="Description of Artificial Sequence: Synthetic peptide"
WVAWISPYGGSTYY

SEQ ID NO: 306 - protein, 10 aa, Artificial Sequence
  source: /note="Description of Artificial Sequence: Synthetic peptide"
RRHWPGGFDY

SEQ ID NO: 307 - protein, 8 aa, Artificial Sequence
  source: /note="Description of Artificial Sequence: Synthetic peptide"
QDVSTAVA

SEQ ID NO: 308 - protein, 11 aa, Artificial Sequence
  source: /note="Description of Artificial Sequence: Synthetic peptide"
LLIYSASFLYS

SEQ ID NO: 309 - protein, 8 aa, Artificial Sequence
  source: /note="Description of Artificial Sequence: Synthetic peptide"
QQYLYHPA

SEQ ID NO: 310 - protein, 9 aa, Artificial Sequence
  source: /note="Description of Artificial Sequence: Synthetic peptide"
YTFTSYVMH

SEQ ID NO: 311 - protein, 14 aa, Artificial Sequence
  source: /note="Description of Artificial Sequence: Synthetic peptide"
WIGYVNPFNDGTKY

SEQ ID NO: 312 - protein, 7 aa, Artificial Sequence
  source: /note="Description of Artificial Sequence: Synthetic peptide"
RQAWGYP

SEQ ID NO: 313 - protein, 12 aa, Artificial Sequence
  source: /note="Description of Artificial Sequence: Synthetic peptide"
ESVEYYGTSLVQ

SEQ ID NO: 314 - protein, 11 aa, Artificial Sequence
  source: /note="Description of Artificial Sequence: Synthetic peptide"
LLIYAASSVDS

SEQ ID NO: 315 - protein, 8 aa, Artificial Sequence
  source: /note="Description of Artificial Sequence: Synthetic peptide"
QQSRRVPY

SEQ ID NO: 316 - protein, 9 aa, Artificial Sequence
  source: /note="Description of Artificial Sequence: Synthetic peptide"
YTFTSYDVH

SEQ ID NO: 317 - protein, 14 aa, Artificial Sequence
  source: /note="Description of Artificial Sequence: Synthetic peptide"
WMGWLHADTGITKF

SEQ ID NO: 318 - protein, 10 aa, Artificial Sequence
  source: /note="Description of Artificial Sequence: Synthetic peptide"
RERIQLWFDY

SEQ ID NO: 319 - protein, 8 aa, Artificial Sequence
  source: /note="Description of Artificial Sequence: Synthetic peptide"
QGISSWLA

SEQ ID NO: 320 - protein, 11 aa, Artificial Sequence
  source: /note="Description of Artificial Sequence: Synthetic peptide"
SLIYAASSLQS

SEQ ID NO: 321 - protein, 8 aa, Artificial Sequence
  source: /note="Description of Artificial Sequence: Synthetic peptide"
QQYNSYPY

SEQ ID NO: 322 - protein, 9 aa, Artificial Sequence
  source: /note="Description of Artificial Sequence: Synthetic peptide"
DTFSTYAIS

SEQ ID NO: 323 - protein, 14 aa, Artificial Sequence
  source: /note="Description of Artificial Sequence: Synthetic peptide"
WMGGIIPIFGKAHY

SEQ ID NO: 324 - protein, 15 aa, Artificial Sequence
  source: /note="Description of Artificial Sequence: Synthetic peptide"
RKFHFVSGSPFGMDV

SEQ ID NO: 325 - protein, 8 aa, Artificial Sequence
  source: /note="Description of Artificial Sequence: Synthetic peptide"
QSVSSYLA

SEQ ID NO: 326 - protein, 11 aa, Artificial Sequence
  source: /note="Description of Artificial Sequence: Synthetic peptide"
LLIYDASNRAT

SEQ ID NO: 327 - protein, 7 aa, Artificial Sequence
  source: /note="Description of Artificial Sequence: Synthetic peptide"
QQRSNWP

SEQ ID NO: 328 - protein, 9 aa, Artificial Sequence
  source: /note="Description of Artificial Sequence: Synthetic peptide"
FTFSSYIMM

SEQ ID NO: 329 - protein, 14 aa, Artificial Sequence
  source: /note="Description of Artificial Sequence: Synthetic peptide"
WVSSIYPSGGITFY

SEQ ID NO: 330 - protein, 12 aa, Artificial Sequence
  source: /note="Description of Artificial Sequence: Synthetic peptide"
RIKLGTVTTVDY

SEQ ID NO: 331 - protein, 11 aa, Artificial Sequence
  source: /note="Description of Artificial Sequence: Synthetic peptide"
SSDVGGYNYVS

SEQ ID NO: 332 - protein, 11 aa, Artificial Sequence
  source: /note="Description of Artificial Sequence: Synthetic peptide"
LMIYDVSNRPS

SEQ ID NO: 333 - protein, 9 aa, Artificial Sequence
  source: /note="Description of Artificial Sequence: Synthetic peptide"
SSYTSSSTR

SEQ ID NO: 334 - protein, 10 aa, Artificial Sequence
  source: /note="Description of Artificial Sequence: Synthetic peptide"
GFNIKDYFLH

SEQ ID NO: 335 - protein, 17 aa, Artificial Sequence
  source: /note="Description of Artificial Sequence: Synthetic peptide"
WINPDNGNTVYDPKFQG

SEQ ID NO: 336 - protein, 12 aa, Artificial Sequence
  source: /note="Description of Artificial Sequence: Synthetic peptide"
RDYTYEKAALDY

SEQ ID NO: 337 - protein, 11 aa, Artificial Sequence
  source: /note="Description of Artificial Sequence: Synthetic peptide"
RASGNIYNYLA

SEQ ID NO: 338 - protein, 7 aa, Artificial Sequence
  source: /note="Description of Artificial Sequence: Synthetic peptide"
DAKTLAD

SEQ ID NO: 339 - protein, 9 aa, Artificial Sequence
  source: /note="Description of Artificial Sequence: Synthetic peptide"
QHFWSLPFT

SEQ ID NO: 340 - protein, 251 aa, Artificial Sequence
  source: /note="Description of Artificial Sequence: Synthetic polypeptide"
KEFILRFSVAHKYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 341 - protein, 251 aa, Artificial Sequence; identical to SEQ ID NO: 10
  source: /note="Description of Artificial Sequence: Synthetic polypeptide"

SEQ ID NO: 342 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSNLVPMVATVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 343 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGILGFVFTLDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 344 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVGILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 345 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDILGFVFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 346 - protein, 251 aa, Artificial Sequence; identical to SEQ ID NO: 7
  source: /note="Description of Artificial Sequence: Synthetic polypeptide"

SEQ ID NO: 347 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVGILGFVFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 348 - protein, 251 aa, Artificial Sequence; identical to SEQ ID NO: 25
  source: /note="Description of Artificial Sequence: Synthetic polypeptide"

SEQ ID NO: 349 - protein, 252 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVGILGFVFTLEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAA

SEQ ID NO: 350 - protein, 251 aa, Artificial Sequence; identical to SEQ ID NO: 9
  source: /note="Description of Artificial Sequence: Synthetic polypeptide"

SEQ ID NO: 351 - protein, 251 aa, Artificial Sequence; identical to SEQ ID NO: 6
  source: /note="Description of Artificial Sequence: Synthetic polypeptide"

SEQ ID NO: 352 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRGILGDVFTLSYVMTAEDVDLTLNWGRLSSVLPDYHGQDSVRVGRISFGSINAILGSVALILNSHHHASAVAA

SEQ ID NO: 353 - protein, 260 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHILRFSVAHKASAVAA

SEQ ID NO: 354 - protein, 262 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHARNLVPMVATVASAVAA

SEQ ID NO: 355 - protein, 251 aa, Artificial Sequence
  source: /note="Description of Artificial Sequence: Synthetic polypeptide"
KEFILRFSVAHKYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 356 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 357 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSNLVPMVATVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 358 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGILGFVFTLDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 359 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVGILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 360 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDILGFVFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 361 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 362 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVGILGFVFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 363 - protein, 251 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDVRGIAPIEARFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLAALSGASYVMTAEDVDLTLNWGRLSSVLPDYHGQDSVRVGRISFGSINAILGSVALILNSHHHASRVAR

SEQ ID NO: 364 - protein, 252 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVGILGFVFTLEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 365 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVNLVPMVATVGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 366 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTNLVPMVATVSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 367 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRGILGDVFTLSYVMTAEDVDLTLNWGRLSSVLPDYHGQDSVRVGRISFGSINAILGSVALILNSHHHASRVAR

SEQ ID NO: 368 - protein, 260 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHILRFSVAHKASRVAR

SEQ ID NO: 369 - protein, 262 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHARNLVPMVATVASRVAR

SEQ ID NO: 370 - protein, 251 aa, Artificial Sequence
  source: /note="Description of Artificial Sequence: Synthetic polypeptide"
KEFILRFSVAHKYVDSLNVIRSAIGTPLQTISSGGTSLLMIDSGIGDNLFAVDVRGIDPEEGRFNNLRLIVERNNLYVTGFVNATNNAFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 371 - protein, 251 aa, Artificial Sequence
  source: /note="Description of Artificial Sequence: Synthetic polypeptide"
AEFILRFSVAHKYVDSLNVIRSAIGTPLQTISSGGTSLLMIDSGIGDNLFAVDVRGIDPEEGRFNNLRLIVERNNLYVTGFVNATNNAFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 372 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDNLVPMVATVVDVRGIDPEEGRFNNLRLIVERNNLYVTGFVNATNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 373 - protein, 251 aa, Artificial Sequence
  source: /note="Description of Artificial Sequence: Synthetic polypeptide"
KEFILRFSVAHKYVDSLNVIRSAIGTPLQTISSGGTSLLMIDSGIGDNLFAVDVRGIDPEEGRFNNLRLIVERNNLYVTGFVNATNNAFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 374 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSNLVPMVATVDVRGIDPEEGRFNNLRLIVERNNLYVTGFVNATNNVFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 375 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSNLVPMVATVDVRGIDPEEGRFNNLRLIVERNNLYVTGFVNATNNVFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVDLTLNWGALSSVLPDYHGQDSVRVGRISFGSINAILGSVALILNSHHHASAVAA

SEQ ID NO: 376 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGILGFVFTLDVRGIDPEEGRFNNLRLIVERNNLYVTGFVNATNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 377 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGILGFVFTLDVRGIDPEEGRFNNLRLIVERNNLYVTGFVNATNNAFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 378 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 379 - protein, 251 aa, Artificial Sequence
  source: /note="Description of Artificial Sequence: Synthetic polypeptide"
KEFILDFITAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 380 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFDFTLGRFNNLRLIVERNNLYVTGFVNATNNAFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 381 - protein, 251 aa, Artificial Sequence
  source: /note="Description of Artificial Sequence: Synthetic polypeptide"
MEFTLDFSTAKTYVDSLNVIRSAIGTPLQTISIGGTSLLMIDSGIGDNLFAVGILGFDFTLGRFNNLRLIVERNNLYVTGFVNATNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 382 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFDFTLGRFNNLRLIVERNNLYVTGFVNATNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 383 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFDFTLGRFNNLRLIVERNNLYVTGFVNATNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 384 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFVFTLGRFNNLRLIVERNNLYVTGFVNATNNVFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 385 - protein, 251 aa, Artificial Sequence
  source: /note="Description of Artificial Sequence: Synthetic polypeptide"
AEFTLDFITAKTYVDSLNVIRSAIGTPLQTISSGGTSLLMIDSGIGDNLFAVDILGFVFTLGRFNNLRLIVERNNLYVTGFVNATNNVFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 386 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 387 - protein, 251 aa, Artificial Sequence
  source: /note="Description of Artificial Sequence: Synthetic polypeptide"
KEFTLDFSIAATYVDSLNVIRSAIGTPLQTISSGGTSLLMIDSGIGDNLFAVDILGFDFTLGRFNNLRLIVERNNLYVTGFVNATNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 388 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFVFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 389 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFVFTLGRFNNLRLIVERNNLYVTGFVNRTNNAFYRFADFSHVTFPGTTAVTLSADSSYTTLQRVAGISRTGMQINRHSLTTSYLALMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 390 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFDFTLGRFNNLRLIVERNNLYVTGFVNRTNNAFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 391 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNAFAVGILGFDFTLGRFNNLRLIVERNNLYVTGFVNRTNNAFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 392 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 393 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLTAVDILGFDFTLGRFNNLRLIVERNNLYVTGFVNRTNNAFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 394 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 395 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFVVGILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 396 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGVDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 397 - protein, 251 aa, Artificial Sequence
  source: /note="Description of Artificial Sequence: Synthetic polypeptide"
MEFTLDFSTAKTYVDSLNVIRSAIGTPLQTISSGGTSLLMIDSGIGDNLFAVGILGVDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 398 - protein, 252 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLEGRFNNLRLIVERNNLYVTGFVNRTNNVFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 399 - protein, 252 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLEGRFNNLRLIVERNNLYVTGFVNRTNNVFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNCHHHASAVAA

SEQ ID NO: 400 - protein, 252 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFVFTLEGRFNNLRLIVERNNLYVTGFVNATNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 401 - protein, 252 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFVFTLEGRFNNLRLIVERNNLYVTGFVNATNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 402 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 403 - protein, 251 aa, Artificial Sequence
  source: /note="Description of Artificial Sequence: Synthetic polypeptide"
AEFILDFIAAKTYVDSLNVIRSAIGTPLQTISSGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 404 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFVFTLGRFNNLRLIVERNNLYVTGFVNATNNAFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 405 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGIGDNLFAVDILGFVFTLGRFNNLRLIVERNNLYVTGFVNATNNAFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 406 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFVFTLGRFNNLRLIVERNNLYVTGFVNATNNVFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 407 - protein, 251 aa, Artificial Sequence
  source: /note="Description of Artificial Sequence: Synthetic polypeptide"
MEFILDFSTAKTYVDSLNVIRSAIGTPLQTISSGGTSLLMIDSGIGDNLFAVGILGFVFTLGRFNNLRLIVERNNLYVTGFVNATNNVFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 408 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 409 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNVFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVALTLNWGALSSVLPDYHGQDSVRVGRISFGSINAILGSVALILNSHHHASAVAA

SEQ ID NO: 410 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFVFTLGRFNNLRLIVERNNLYVTGFVNATNNVFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 411 - protein, 251 aa, Artificial Sequence
  source: /note="Description of Artificial Sequence: Synthetic polypeptide"
AEFTLDFSTAKTYVDSLNVIRSAIGTPLQTISCGGTSLLMIDSGIGDNLFAVDILGFVFTLGRFNNLRLIVERNNLYVTGFVNATNNVFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 412 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 413 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNATAVGILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 414 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 415 - protein, 251 aa, Artificial Sequence
  source: /note="Description of Artificial Sequence: Synthetic polypeptide"
KEFTLDFIIAKTYVDSLNVIRSAIGTPLQTISCGGTSLLMIDSGIGDNLFAVGILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 416 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFDFTLGRFNNLRLIVERNNLYVTGFVNRTNNAFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 417 - protein, 251 aa, Artificial Sequence
  source: /note="Description of Artificial Sequence: Synthetic polypeptide"
KEFTLDFSTAKTYVDSLNVIRSAIGTPLQTISCGGTSLLMIDSGIGDNLFAVGILGFDFTLGRFNNLRLIVERNNLYVTGFVNRTNNAFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 418 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 419 - protein, 251 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 420 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 421 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVDLTLNWGRLSSVLPDYHGQDSVRVGRISFGSINAILGSVALILNCHHHASAVAA

SEQ ID NO: 422 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 423 - protein, 251 aa, Artificial Sequence
  source: /note="Description of Artificial Sequence: Synthetic polypeptide"
MEFTLDFSTAKTYVDSLNVIRSAIGTPLQTISSGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLALMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNCHHHASAVAA

SEQ ID NO: 424 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNVFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 425 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 426 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 427 - protein, 251 aa, Artificial Sequence
  source: /note="Description of Artificial Sequence: Synthetic polypeptide"
AEFILDFSTAKTYVDSLNVIRSAIGTPLQTISCGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLDLMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 428 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 429 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVALTLNWGALSSVLPDYHGQDSVRVGRISFGSINAILGSVALILNSHHHASAVAA

SEQ ID NO: 430 - protein, 251 aa, Artificial Sequence; identical to SEQ ID NO: 425
  source: /note="Description of Artificial Sequence: Synthetic polypeptide"

SEQ ID NO: 431 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTNLVPMVATVSYTTLQRVAGISRTGMQINRHSLTTSYLDLMSHSGTSLTQSVARAMLRFVTVTAEALRFRQIQRGFRTTLDDLSGASYVMTAEDVALTLNWGRLSSVLPDYHGQDSVRVGRISFGSINAILGSVALILNSHHHASAVAA

SEQ ID NO: 432 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNAFYRFADFSHVTFPGTNLVPMVATVSYTTLQRVAGISRTGMQINRHSLTTSYLDLMSHSGTSLTQSVARAMLRFVTVTAEALRFRQIQRGFRTTLDDLSGASYVMTAEAVALTLNWGRLSSVLPDYHGQDSVRVGRISFGSINAILGSVALILNSHHHASAVAA

SEQ ID NO: 433 - protein, 251 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSAARAMLRFVTVTAEALRFRQIQRGFRGILGDVFTLSYVMTAEDVDLTLNWGRLSSVLPDYHGQDSVRVGRISFGSINAILGSVALILNSHHHASAVAA

SEQ ID NO: 434 - protein, 251 aa, Artificial Sequence
  source: /note="Description of Artificial Sequence: Synthetic polypeptide"
AEFILDFSIAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLALMSHSGTSLTQSAARAMLRFVTVTAEALRFRQIQRGFRGILGDVFTLSYVMTAEDVDLTLNWGRLSSVLPDYHGQDSVRVGRISFGSINAILGSVALILNSHHHASAVAA

SEQ ID NO: 435 - protein, 260 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHILRFSVAHKASAVAA

SEQ ID NO: 436 - protein, 260 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVALTLNWGALSSVLPDYHGQDSVRVGRISFGSINAILGSVALILNSHHHILRFSVAHKASAVAA

SEQ ID NO: 437 - protein, 262 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHARNLVPMVATVASAVAA

SEQ ID NO: 438 - protein, 262 aa, Artificial Sequence
  source: /note="Description of Artificial Sequence: Synthetic polypeptide"
MEFTLDFIIAKTYVDSLNVIRSAIGTPLQTISCGGTSLLMIDSGIGDNLFAVDILGFDFTLGRFNNLRLIVERNNLYVTGFVNATNNAFYRFADFSHVTFPGTTAVTLSADSSYTTLQRVAGISRTGMQINRHSLTTSYLALMSHSGTSLTQSAARAMLRFVTVTAEALRFRQIQRGFRTTLDDLSGASYVMTAEDVALTLNWGRLSSVLPDYHGQDSVRVGRISFGSINAILGSVALILNSHHHARNLVPMVATVASAVAA

SEQ ID NO: 439 - protein, 511 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 440 - protein, 519 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 441 - protein, 512 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVNLVPMVATVGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 442 - protein, 512 aa, Artificial Sequence
  source: /note="Description of Artificial Sequence: Synthetic polypeptide"
KEFTLDFSTAKTYVDSLNVIRSAIGTPLQTISSGGTSLLMIDNLVPMVATVVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 443 - protein, 511 aa, Artificial Sequence
  source: /note="Description of Artificial Sequence: Synthetic polypeptide"
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 444 - protein, 511 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAAEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 445 - protein, 511 aa, Artificial Sequence
  source: /note="Description of Artificial Sequence: Synthetic polypeptide"
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASRVAR

SEQ ID NO: 446 - protein, 511 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNCHHHASAVAAEFPKPSTPPGSSGGAPQVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELK

SEQ ID NO: 447 - protein, 499 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPRTFGQGTKVEIKGGGGSQVQLVQSGAEVKKPGSSVKVSCKASGGTFSSYAFSWVRQAPGQGLEWMGRVIPFLGIANSAQKFQGRVTITADKSTSTAYMDLSSLRSEDTAVYYCARDDIAALGPFDYWGQGTLVTVSS

SEQ ID NO: 448 - protein, 498 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 449 - protein, 518 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSGGGGSGGGGSGGGGSGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 450 - protein, 521 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIKGGGGSGGGGSGGGGSGGGGSGGGGSQVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 451 - protein, 521 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSSGGGGSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 452 - protein, 500 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCKASQSVDFDGDSYMNWYQQKPGQPPKVLIYAASNLESGIPARFSGSGSGTDFTLNIHPVEEEDAATYYCQQSNEDPWTFGGGTKLEIKGGGGSQIQLQQSGPEVVKPGASVKISCKASGYTFTDYYITWVKQKPGQGLEWIGWIYPGSGNTKYNEKFKGKATLTVDTSSSTAFMQLSSLTSEDTAVYFCANYGNYWFAYWGQGTQVTVSA

SEQ ID NO: 453 - protein, 498 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 454 - protein, 519 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 455 - protein, 515 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKGSTSGSGKPGSGEGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSS

SEQ ID NO: 456 - protein, 512 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQTTSSLSASLGDRVTISCRASQDISNYLAWYQQKPDGTVKLLIYYTSILHSGVPSRFSGSGSGTDYSLTISNLEQEDFATYFCQQGNTLPWTFGCGTKLEIKGSTSGSGKPGSGEGSEVQLVESGGGLVKPGGSLKLSCAASGFAFSIYDMSWVRQTPEKCLEWVAYISSGGGTTYYPDTVKGRFTISRDNAKNTLYLQMSSLKSEDTAMYYCARHSGYGTHWGVLFAYWGQGTLVTVSA

SEQ ID NO: 457 - protein, 511 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 458 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSS

SEQ ID NO: 459 - protein, 498 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFVFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 460 - protein, 497 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFVFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 461 - protein, 497 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFVFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 462 - protein, 498 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 463 - protein, 497 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 464 - protein, 497 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFDFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 465 - protein, 498 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 466 - protein, 512 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 467 - protein, 511 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTGSTSGSGKPGSGEGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSS

SEQ ID NO: 468 - protein, 507 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSS

SEQ ID NO: 469 - protein, 519 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 470 - protein, 515 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKGSTSGSGKPGSGEGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSS

SEQ ID NO: 471 - protein, 512 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQTTSSLSASLGDRVTISCRASQDISNYLAWYQQKPDGTVKLLIYYTSILHSGVPSRFSGSGSGTDYSLTISNLEQEDFATYFCQQGNTLPWTFGCGTKLEIKGSTSGSGKPGSGEGSEVQLVESGGGLVKPGGSLKLSCAASGFAFSIYDMSWVRQTPEKCLEWVAYISSGGGTTYYPDTVKGRFTISRDNAKNTLYLQMSSLKSEDTAMYYCARHSGYGTHWGVLFAYWGQGTLVTVSA

SEQ ID NO: 472 - protein, 500 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCKASQSVDFDGDSYMNWYQQKPGQPPKVLIYAASNLESGIPARFSGSGSGTDFTLNIHPVEEEDAATYYCQQSNEDPWTFGGGTKLEIKGGGGSQIQLQQSGPEVVKPGASVKISCKASGYTFTDYYITWVKQKPGQGLEWIGWIYPGSGNTKYNEKFKGKATLTVDTSSSTAFMQLSSLTSEDTAVYFCANYGNYWFAYWGQGTQVTVSA

SEQ ID NO: 473 - protein, 498 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPQITLKESGPGILQPSQTLSLTCSFSGFSLTTYGIGVGWIRQPPGKGLEWLTHIWWNDNKYYNTALRSRLTISKDSSNNQVLLKIANVDTADTATYYCLYGYTYWGQGTLVTVSAGGGGSDVVMTQTPLSLPVSLGDQASISCRSSQSLLYSNGNTYLHWYLQKPGQSPKLLIYKLSNRFSGVPDRFSGSGSGTDFTLKISRVEAEDLGVYFCSQSTHVPWTFGGGTKLEIK

SEQ ID NO: 474 - protein, 498 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 475 - protein, 498 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFVFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 476 - protein, 497 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFVFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 477 - protein, 497 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVGILGFVFTLGRFNNLRLIVERNNLYVTGFVNRTNNVFYRFADFSHVTFPGTTAVTLSADSSYTTLQRVAGISRTGMQINRHSLTTSYLDLMSHSGTSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIK

SEQ ID NO: 478 - protein, 498 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 479 - protein, 500 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSA

SEQ ID NO: 480 - protein, 511 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRGILGDVFTRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 481 - protein, 511 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 482 - protein, 498 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 483 - protein, 519 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 484 - protein, 498 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 485 - protein, 498 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 486 - protein, 500 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSA

SEQ ID NO: 487 - protein, 500 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCKASQSVDFDGDSYMNWYQQKPGQPPKVLIYAASNLESGIPARFSGSGSGTDFTLNIHPVEEEDAATYYCQQSNEDPWTFGGGTKLEIKGGGGSQIQLQQSGPEVVKPGASVKISCKASGYTFTDYYITWVKQKPGQGLEWIGWIYPGSGNTKYNEKFKGKATLTVDTSSSTAFMQLSSLTSEDTAVYFCANYGNYWFAYWGQGTQVTVSA

SEQ ID NO: 488 - protein, 515 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKGSTSGSGKPGSGEGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSS

SEQ ID NO: 489 - protein, 511 aa, Artificial Sequence
  source: /note="Description of Artificial Sequence: Synthetic polypeptide"
QVQLQQPGAELVKPGASVKMSCKTSGYTFTSYNVHWVKQTPGQGLEWIGAIYPGNGDTSFNQKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKPSTPPGSSGGAPKEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAA

SEQ ID NO: 490 - protein, 512 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQTTSSLSASLGDRVTISCRASQDISNYLAWYQQKPDGTVKLLIYYTSILHSGVPSRFSGSGSGTDYSLTISNLEQEDFATYFCQQGNTLPWTFGCGTKLEIKGSTSGSGKPGSGEGSEVQLVESGGGLVKPGGSLKLSCAASGFAFSIYDMSWVRQTPEKCLEWVAYISSGGGTTYYPDTVKGRFTISRDNAKNTLYLQMSSLKSEDTAMYYCARHSGYGTHWGVLFAYWGQGTLVTVSA

SEQ ID NO: 491 - protein, 511 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 492 - protein, 507 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKGSTSGSGKPGSGEGSKVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSS

SEQ ID NO: 493 - protein, 498 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPQITLKESGPGILQPSQTLSLTCSFSGFSLTTYGIGVGWIRQPPGKGLEWLTHIWWNDNKYYNTALRSRLTISKDSSNNQVLLKIANVDTADTATYYCLYGYTYWGQGTLVTVSAGGGGSDVVMTQTPLSLPVSLGDQASISCRSSQSLLYSNGNTYLHWYLQKPGQSPKLLIYKLSNRFSGVPDRFSGSGSGTDFTLKISRVEAEDLGVYFCSQSTHVPWTFGGGTKLEIK

SEQ ID NO: 494 - protein, 519 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGSGGGGSGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 495 - protein, 498 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCRATESVEYYGTSLVQWYQQKPGQPPKLLIYAASSVDSGVPARFSGSGSGTDFSLTIHPVEEDDIAMYFCQQSRRVPYTFGGGTKLEIKGGGGSEVQLQQSGPELVKPGASVKMSCKASGYTFTSYVMHWVKQKPGQGLEWIGYVNPFNDGTKYNEMFKGKATLTSDKSSSTAYMELSSLTSEDSAVYYCARQAWGYPWGQGTLVTVSA

SEQ ID NO: 496 - protein, 498 aa, Artificial Sequence
  source: /note="Description of Artificial Sequence: Synthetic polypeptide"
AEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 497 - protein, 498 aa, Artificial Sequence
  source: /note="Description of Artificial Sequence: Synthetic polypeptide"
AEFILDFSTAKTYVDSLNVIRSAIGTPLQTISSGGTSLLMIDSGIGDNLFAVNLVPMVATVGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 498 - protein, 498 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDVRGIAPIEARFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLAALSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 499 - protein, 509 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHARNLVPMVATVASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 500 - protein, 498 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDILGFDFTLGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSS

SEQ ID NO: 501 - protein, 512 aa, Artificial Sequence
  source: /note="Description of Artificial Sequence: Synthetic polypeptide"
KEFTLDFSTAKTYVDSLNVIRSAIGTPLQTISSGGTSLLMIDSGSGDNLFAVDVRGIAPEEGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGSTSGSGKPGSGEGSTKGQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 502 - protein, 506 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDVQVTQSPSSLSASVGDRVTITCRSSQSLANSYGNTFLSWYLHKPGKAPQLLIYGISNRFSGVPDRFSGSGSGTDFTLTISSLQPEDFATYYCLQGTHQPYTFGQGTKVEIKGGGGSEVQLVQSGAEVKKPGASVKVSCKASGYRFTNYWIHWVRQAPGQGLEWIGGINPGNNYATYRRKFQGRVTMTADTSTSTVYMELSSLRSEDTAVYYCTREGYGNYGAWFAYWGQGTLVTVSSA

SEQ ID NO: 503 - protein, 500 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIVLTQSPASLAVSLGQRATISCKASQSVDFDGDSYMNWYQQKPGQPPKVLIYAASNLESGIPARFSGSGSGTDFTLNIHPVEEEDAATYYCQQSNEDPWTFGGGTKLEIKGGGGSQIQLQQSGPEVVKPGASVKISCKASGYTFTDYYITWVKQKPGQGLEWIGWIYPGSGNTKYNEKFKGKATLTVDTSSSTAFMQLSSLTSEDTAVYFCANYGNYWFAYWGQGTQVTVSA

SEQ ID NO: 504 - protein, 499 aa, Artificial Sequence
  source: /note="Description of Artificial Sequence: Synthetic polypeptide"
KEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 505 - protein, 499 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDVRGIAPIEARFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLAALSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 506 - protein, 499 aa, Artificial Sequence
  source: /note="Description of Artificial Sequence: Synthetic polypeptide"
KEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 507 - protein, 499 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 508 - protein, 499 aa, Artificial Sequence
  source: /note="Description of Artificial Sequence: Synthetic polypeptide"
AEFILDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGASYVMTAEDVDLTLNWGRLSSVLPDYHGQDSVRVGRISFGSINAILGSVALILNSHHHASAVAAEFPKPSTPPGSSGGAPDIQMTQSPSSLSASVGDRVTITCKASEDIYNRLTWYQQKPGKAPKLLISGATSLETGVPSRFSGSGSGTDFTFTISSLQPEDIATYYCQQYWSNPYTFGQGTKVEIKGGGGSQVQLQESGPGLVRPSQTLSLTCTVSGFSLTSYGVHWVRQPPGRGLEWIGVMWRGGSTDYNAAFMSRLNITKDNSKNQVSLRLSSVTAADTAVYYCAKSMITTGFVMDSWGQGSLVTVSSA

SEQ ID NO: 509 - protein, 499 aa, Artificial Sequence; identical to SEQ ID NO: 504
  source: /note="Description of Artificial Sequence: Synthetic polypeptide"

SEQ ID NO: 510 - protein, 499 aa, Artificial Sequence; identical to SEQ ID NO: 506
  source: /note="Description of Artificial Sequence: Synthetic polypeptide"

SEQ ID NO: 511 - protein, 500 aa, Artificial Sequence; identical to SEQ ID NO: 479
  source: /note="Description of Artificial Sequence: Synthetic polypeptide"

SEQ ID NO: 512 - protein, 513 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPAIQMSQSPASLSASVGETVTITCRASGNIYNYLAWYQQKQGKSPHLLVYDAKTLADGVPSRFSGSGSGTQYSLKISSLQTEDSGNYYCQHFWSLPFTFGSGTKLEIKGSTSGSGKPGSGEGSTKGEVQLQQSGAELVRPGALVKLSCKTSGFNIKDYFLHWVRQRPDQGLEWIGWINPDNGNTVYDPKFQGTASLTADTSSNTVYLQLSGLTSEDTAVYFCTRRDYTYEKAALDYWGQGTTVTVST

SEQ ID NO: 513 - protein, 517 aa, Artificial Sequence
  source: /note="Description of Artificial Sequence: Synthetic polypeptide"
AEFTLDFSTAKTYVDSLNVIRSAIGTPLQTISSGGTSLLMIDSGIGDNLFAVDILGFDFTLGRFNNLRLIVERNNLYVTGFVNRTNNVFYRFADFSHVTFPGTTAVTLSADSSYTTLQRVAGISRTGMQINRHSLTTSYLDLMSHSATSLTQSVARAMLRFVTVTAEALRFRQIQRGFRTTLDDLSGRSYVMTAEDVDLTLNWGRLSSVLPDYHGQDSVRVGRISFGSINAILGSVALILNSHHHASAVAAEFPKPSTPPGSSGGAPDIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKGSTSGSGKPGSGEGSTKGQVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSS

SEQ ID NO: 514 - protein, 4 aa, Artificial Sequence
  source: /note="Description of Artificial Sequence: Synthetic peptide"
KDEL

SEQ ID NO: 515 - protein, 4 aa, Artificial Sequence
  source: /note="Description of Artificial Sequence: Synthetic peptide"
HDEL

SEQ ID NO: 516 - protein, 4 aa, Artificial Sequence
  source: /note="Description of Artificial Sequence: Synthetic peptide"
RDEL

SEQ ID NO: 517 - protein, 4 aa, Artificial Sequence
  source: /note="Description of Artificial Sequence: Synthetic peptide"
WDEL

SEQ ID NO: 518 - protein, 4 aa, Artificial Sequence
  source: /note="Description of Artificial Sequence: Synthetic peptide"
YDEL

SEQ ID NO: 519 - protein, 4 aa, Artificial Sequence
  source: /note="Description of Artificial Sequence: Synthetic peptide"
HEEL

SEQ ID NO: 520 - protein, 4 aa, Artificial Sequence
  source: /note="Description of Artificial Sequence: Synthetic peptide"
KEEL

SEQ ID NO: 521 - protein, 4 aa, Artificial Sequence
  source: /note="Description of Artificial Sequence: Synthetic peptide"
REEL

SEQ ID NO: 522 - protein, 4 aa, Artificial Sequence
  source: /note="Description of Artificial Sequence: Synthetic peptide"
KFEL

SEQ ID NO: 523 - protein, 4 aa, Artificial Sequence
  source: /note="Description of Artificial Sequence: Synthetic peptide"
KIEL

SEQ ID NO: 524 - protein, 4 aa, Artificial Sequence
  source: /note="Description of Artificial Sequence: Synthetic peptide"
DKEL

SEQ ID NO: 525 - protein, 4 aa, Artificial Sequence
  source: /note="Description of Artificial Sequence: Synthetic peptide"
KKEL

SEQ ID NO: 526 - protein, 4 aa, Artificial Sequence
  source: /note="Description of Artificial Sequence: Synthetic peptide"
HNEL

SEQ ID NO: 527 - protein, 4 aa, Artificial Sequence
  source: /note="Description of Artificial Sequence: Synthetic peptide"
HTEL

SEQ ID NO: 528 - protein, 4 aa, Artificial Sequence
  source: /note="Description of Artificial Sequence: Synthetic peptide"
KTEL

SEQ ID NO: 529 - protein, 4 aa, Artificial Sequence
  source: /note="Description of Artificial Sequence: Synthetic peptide"
HVEL

SEQ ID NO: 530 - protein, 6 aa, Artificial Sequence
  source: /note="Description of Artificial Sequence: Synthetic peptide"
ALEDEL

SEQ ID NO: 531 - protein, 6 aa, Artificial Sequence
  source: /note="Description of Artificial Sequence: Synthetic peptide"
HAEDEL

SEQ ID NO: 532 - protein, 6 aa, Artificial Sequence
  source: /note="Description of Artificial Sequence: Synthetic peptide"
HLEDEL

SEQ ID NO: 533 - protein, 6 aa, Artificial Sequence
  source: /note="Description of Artificial Sequence: Synthetic peptide"
KLEDEL

SEQ ID NO: 534 - protein, 6 aa, Artificial Sequence
  source: /note="Description of Artificial Sequence: Synthetic peptide"
IRSDEL

SEQ ID NO: 535 - protein, 6 aa, Artificial Sequence
  source: /note="Description of Artificial Sequence: Synthetic peptide"
ERSTEL

SEQ ID NO: 536 - protein, 6 aa, Artificial Sequence
  source: /note="Description of Artificial Sequence: Synthetic peptide"
RPSTEL

SEQ ID NO: 537 - protein, 4 aa, Artificial Sequence
  source: /note="Description of Artificial Sequence: Synthetic peptide"
RVKR

SEQ ID NO: 538 - protein, 6 aa, Artificial Sequence
  source: /note="Description of Artificial Sequence: Synthetic peptide"
ASGGPE

SEQ ID NO: 539 - protein, 54 aa, Artificial Sequence
  source: /note="Description of Artificial Sequence: Synthetic polypeptide"
  VARIANT (5)..(6): /replace=" "
  VARIANT (10)..(11): /replace=" "
  VARIANT (15)..(16): /replace=" "
  VARIANT (20)..(21): /replace=" "
  VARIANT (25)..(26): /replace=" "
  VARIANT (30)..(31): /replace=" "
  VARIANT (35)..(36): /replace=" "
  VARIANT (40)..(41): /replace=" "
  VARIANT (45)..(46): /replace=" "
  VARIANT (50)..(51): /replace=" "
  MISC_FEATURE (3)..(54): /note="This region may encompass 1-10 'Gly(2-4)Ser' repeating units"
  MISC_FEATURE (1)..(54): /note="Variant residues given in the sequence have no preference with respect to those in the annotations for variant positions"
AMGGGGSGGGGSGGGGSGGGGSGGGGSGGGGSGGGGSGGGGSGGGGSGGGGSAM

SEQ ID NO: 540 - protein, 210 aa, Artificial Sequence
  source: /note="Description of Artificial Sequence: Synthetic polypeptide"
  VARIANT (2)..(6): /replace=" "
  VARIANT (9)..(13): /replace=" "
  VARIANT (16)..(20): /replace=" "
  VARIANT (23)..(27): /replace=" "
  VARIANT (30)..(34): /replace=" "
  VARIANT (37)..(41): /replace=" "
  VARIANT (44)..(48): /replace=" "
  VARIANT (51)..(55): /replace=" "
  VARIANT (58)..(62): /replace=" "
  VARIANT (65)..(69): /replace=" "
  VARIANT (72)..(76): /replace=" "
  VARIANT (79)..(83): /replace=" "
  VARIANT (86)..(90): /replace=" "
  VARIANT (93)..(97): /replace=" "
  VARIANT (100)..(104): /replace=" "
  VARIANT (107)..(111): /replace=" "
  VARIANT (114)..(118): /replace=" "
  VARIANT (121)..(125): /replace=" "
  VARIANT (128)..(132): /replace=" "
  VARIANT (135)..(139): /replace=" "
  VARIANT (142)..(146): /replace=" "
  VARIANT (149)..(153): /replace=" "
  VARIANT (156)..(160): /replace=" "
  VARIANT (163)..(167): /replace=" "
  VARIANT (170)..(174): /replace=" "
  VARIANT (177)..(181): /replace=" "
  VARIANT (184)..(188): /replace=" "
  VARIANT (191)..(195): /replace=" "
  VARIANT (198)..(202): /replace=" "
  VARIANT (205)..(209): /replace=" "
  MISC_FEATURE (1)..(210): /note="This sequence may encompass 1-30 '(Gly)X-Ser' repeating units, wherein X represents 1-6"
  MISC_FEATURE (1)..(210): /note="Variant residues given in the sequence have no preference with respect to those in the annotations for variant positions"
GGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGSGGGGGGS

SEQ ID NO: 541 - protein, 210 aa, Artificial Sequence
  source: /note="Description of Artificial Sequence: Synthetic polypeptide"
  VARIANT (2)..(6): /replace=" "
  VARIANT (9)..(13): /replace=" "
  VARIANT (16)..(20): /replace=" "
  VARIANT (23)..(27): /replace=" "
  VARIANT (30)..(34): /replace=" "
  VARIANT (37)..(41): /replace=" "
  VARIANT (44)..(48): /replace=" "
  VARIANT (51)..(55): /replace=" "
  VARIANT (58)..(62): /replace=" "
  VARIANT (65)..(69): /replace=" "
  VARIANT (72)..(76): /replace=" "
  VARIANT (79)..(83): /replace=" "
  VARIANT (86)..(90): /replace=" "
  VARIANT (93)..(97): /replace=" "
  VARIANT (100)..(104): /replace=" "
  VARIANT (107)..(111): /replace=" "
  VARIANT (114)..(118): /replace=" "
  VARIANT (121)..(125): /replace=" "
  VARIANT (128)..(132): /replace=" "
  VARIANT (135)..(139): /replace=" "
  VARIANT (142)..(146): /replace=" "
  VARIANT (149)..(153): /replace=" "
  VARIANT (156)..(160): /replace=" "
  VARIANT (163)..(167): /replace=" "
  VARIANT (170)..(174): /replace=" "
  VARIANT (177)..(181): /replace=" "
  VARIANT (184)..(188): /replace=" "
  VARIANT (191)..(195): /replace=" "
  VARIANT (198)..(202): /replace=" "
  VARIANT (205)..(209): /replace=" "
  MISC_FEATURE (1)..(210): /note="This sequence may encompass 1-30 '(Ser)X-Gly' repeating units, wherein X represents 1-6"
  MISC_FEATURE (1)..(210): /note="Variant residues given in the sequence have no preference with respect to those in the annotations for variant positions"
SSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSGSSSSSSG

SEQ ID NO: 542 - protein, 150 aa, Artificial Sequence
  source: /note="Description of Artificial Sequence: Synthetic polypeptide"
  MISC_FEATURE (1)..(150): /note="This sequence may encompass 1-30 'Gly-Gly-Gly- Gly-Ser' repeating units"
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 543 - protein, 30 aa, Artificial Sequence
  source: /note="Description of Artificial Sequence: Synthetic polypeptide"
  VARIANT (2)..(30): /replace=" "
  MISC_FEATURE (1)..(30): /note="Variant residues given in the sequence have no preference with respect to those in the annotations for variant positions"
GGGGGGGGGGGGGGGGGGGGGGGGGGGGGG

SEQ ID NO: 544 - protein, 12 aa, Artificial Sequence
  source: /note="Description of Artificial Sequence: Synthetic peptide"
GKSSGSGSESKS

SEQ ID NO: 545 - protein, 14 aa, Artificial Sequence
  source: /note="Description of Artificial Sequence: Synthetic peptide"
EGKSSGSGSESKEF

SEQ ID NO: 546 - protein, 14 aa, Artificial Sequence
  source: /note="Description of Artificial Sequence: Synthetic peptide"
GSTSGSGKSSEGKG

SEQ ID NO: 547 - protein, 18 aa, Artificial Sequence
  source: /note="Description of Artificial Sequence: Synthetic peptide"
GSTSGSGKSSEGSGSTKG

SEQ ID NO: 548 - protein, 18 aa, Artificial Sequence
  source: /note="Description of Artificial Sequence: Synthetic peptide"
GSTSGSGKPGSGEGSTKG

SEQ ID NO: 549 - protein, 5 aa, Artificial Sequence
  source: /note="Description of Artificial Sequence: Synthetic peptide"
SRSSG

SEQ ID NO: 550 - protein, 5 aa, Artificial Sequence
  source: /note="Description of Artificial Sequence: Synthetic peptide"
SGSSC

SEQ ID NO: 551 - protein, 28 aa, Artificial Sequence
  source: /note="Description of Artificial Sequence: Synthetic peptide"
AMGRSGGGCAGNRVGSSLSCGGLNLQAM

SEQ ID NO: 552 - protein, 15 aa, Artificial Sequence
  source: /note="Description of Artificial Sequence: Synthetic peptide"
GGGGSGGGGSGGGGS

SEQ ID NO: 553 - protein, 3 aa, Artificial Sequence
  source: /note="Description of Artificial Sequence: Synthetic peptide"
GGS

SEQ ID NO: 554 - protein, 4 aa, Artificial Sequence
  source: /note="Description of Artificial Sequence: Synthetic peptide"
GGGS

SEQ ID NO: 555 - protein, 5 aa, Artificial Sequence
  source: /note="Description of Artificial Sequence: Synthetic peptide"
GGGGS

SEQ ID NO: 556 - protein, 8 aa, Artificial Sequence
  source: /note="Description of Artificial Sequence: Synthetic peptide"
GGGGSGGG

SEQ ID NO: 557 - protein, 7 aa, Artificial Sequence
  source: /note="Description of Artificial Sequence: Synthetic peptide"
GGSGGGG

SEQ ID NO: 558 - protein, 18 aa, Artificial Sequence
  source: /note="Description of Artificial Sequence: Synthetic peptide"
GSTSGGGSGGGSGGGGSS

SEQ ID NO: 559 - protein, 18 aa, Artificial Sequence
  source: /note="Description of Artificial Sequence: Synthetic peptide"
GSTSGSGKPGSSEGSTKG

SEQ ID NO: 560 - protein, 9 aa, Artificial Sequence
  source: /note="Description of Artificial Sequence: Synthetic peptide"
GVMTRGRLK

SEQ ID NO: 561 - protein, 4 aa, Artificial Sequence
  source: /note="Description of Artificial Sequence: Synthetic peptide"
HDEF

SEQ ID NO: 562 - protein, 4 aa, Artificial Sequence
  source: /note="Description of Artificial Sequence: Synthetic peptide"
RDEF

SEQ ID NO: 563 - protein, 4 aa, Artificial Sequence
  source: /note="Description of Artificial Sequence: Synthetic peptide"
HEEF

SEQ ID NO: 564 - protein, 4 aa, Artificial Sequence
  source: /note="Description of Artificial Sequence: Synthetic peptide"
KAEL

SEQ ID NO: 565 - protein, 4 aa, Artificial Sequence
  source: /note="Description of Artificial Sequence: Synthetic peptide"
KCEL

SEQ ID NO: 566 - protein, 4 aa, Artificial Sequence
  source: /note="Description of Artificial Sequence: Synthetic peptide"
KGEL

SEQ ID NO: 567 - protein, 4 aa, Artificial Sequence
  source: /note="Description of Artificial Sequence: Synthetic peptide"
KHEL

SEQ ID NO: 568 - protein, 4 aa, Artificial Sequence
  source: /note="Description of Artificial Sequence: Synthetic peptide"
KLEL

SEQ ID NO: 569 - protein, 4 aa, Artificial Sequence
  source: /note="Description of Artificial Sequence: Synthetic peptide"
KNEL

SEQ ID NO: 570 - protein, 4 aa, Artificial Sequence
  source: /note="Description of Artificial Sequence: Synthetic peptide"
KQEL

SEQ ID NO: 571 - protein, 4 aa, Artificial Sequence
  source: /note="Description of Artificial Sequence: Synthetic peptide"
KREL

SEQ ID NO: 572 - protein, 4 aa, Artificial Sequence
  source: /note="Description of Artificial Sequence: Synthetic peptide"
KSEL

SEQ ID NO: 573 - protein, 4 aa, Artificial Sequence
  source: /note="Description of Artificial Sequence: Synthetic peptide"
KVEL

SEQ ID NO: 574 - protein, 4 aa, Artificial Sequence
  source: /note="Description of Artificial Sequence: Synthetic peptide"
KWEL

SEQ ID NO: 575 - protein, 4 aa, Artificial Sequence
  source: /note="Description of Artificial Sequence: Synthetic peptide"
KYEL

SEQ ID NO: 576 - protein, 4 aa, Artificial Sequence
  source: /note="Description of Artificial Sequence: Synthetic peptide"
KEDL

SEQ ID NO: 577 - protein, 4 aa, Artificial Sequence
  source: /note="Description of Artificial Sequence: Synthetic peptide"
FDEL

SEQ ID NO: 578 - protein, 4 aa, Artificial Sequence
  source: /note="Description of Artificial Sequence: Synthetic peptide"
KDEF

SEQ ID NO: 579 - protein, 4 aa, Artificial Sequence
  source: /note="Description of Artificial Sequence: Synthetic peptide"
HADL

SEQ ID NO: 580 - protein, 4 aa, Artificial Sequence
  source: /note="Description of Artificial Sequence: Synthetic peptide"
HAEL

SEQ ID NO: 581 - protein, 4 aa, Artificial Sequence
  source: /note="Description of Artificial Sequence: Synthetic peptide"
HIEL

SEQ ID NO: 582 - protein, 4 aa, Artificial Sequence
  source: /note="Description of Artificial Sequence: Synthetic peptide"
NDEL

SEQ ID NO: 583 - protein, 4 aa, Artificial Sequence
  source: /note="Description of Artificial Sequence: Synthetic peptide"
QDEL

SEQ ID NO: 584 - protein, 4 aa, Artificial Sequence
  source: /note="Description of Artificial Sequence: Synthetic peptide"
REDL

SEQ ID NO: 585 - protein, 4 aa, Artificial Sequence
  source: /note="Description of Artificial Sequence: Synthetic peptide"
RNEL

SEQ ID NO: 586 - protein, 4 aa, Artificial Sequence
  source: /note="Description of Artificial Sequence: Synthetic peptide"
RTDL

SEQ ID NO: 587 - protein, 4 aa, Artificial Sequence
  source: /note="Description of Artificial Sequence: Synthetic peptide"
RTEL

SEQ ID NO: 588 - protein, 4 aa, Artificial Sequence
  source: /note="Description of Artificial Sequence: Synthetic peptide"
SDEL

SEQ ID NO: 589 - protein, 4 aa, Artificial Sequence
  source: /note="Description of Artificial Sequence: Synthetic peptide"
TDEL

SEQ ID NO: 590 - protein, 4 aa, Artificial Sequence
  source: /note="Description of Artificial Sequence: Synthetic peptide"
SKEL

SEQ ID NO: 591 - protein, 4 aa, Artificial Sequence
  source: /note="Description of Artificial Sequence: Synthetic peptide"
STEL

SEQ ID NO: 592 - protein, 4 aa, Artificial Sequence
  source: /note="Description of Artificial Sequence: Synthetic peptide"
EDEL

SEQ ID NO: 593 - protein, 12 aa, Unknown
  source: /note="Description of Unknown: Shiga toxin A1 peptide fragment"
RGIDPEEGRFNN

SEQ ID NO: 594 - protein, 10 aa, Unknown
  source: /note="Description of Unknown: Shiga toxin A1 peptide fragment"
HGQDSVRVGR

The invention is claimed as follows:

1. A Shiga toxin effector polypeptide comprising an amino acid sequence having at least 90% identity to amino acids 1 to 251 of SEQ ID NO: 1;

wherein the amino acid sequence comprises amino acid substitutions V54I, R55L, I57F, P59F, E60T, E61L, S45I, G110A, R188A, C242S, R248A and R251A according to SEQ ID NO: 1; and wherein the amino acid sequence comprises an asparagine at the amino acid residue corresponding to position 75 of SEQ ID NO: 1, a tyrosine at the amino acid residue corresponding to position 77 of SEQ ID NO: 1, a tyrosine at the amino acid residue corresponding to position 114 of SEQ ID NO: 1, a glutamate at the amino acid residue corresponding to position 167 of SEQ ID NO: 1, an arginine at the amino acid residue corresponding to position 170 of SEQ ID NO: 1, an arginine at the amino acid residue corresponding to position 176 of SEQ ID NO: 1, and a tryptophan at the amino acid residue corresponding to position 203 of SEQ ID NO: 1.

2. The Shiga toxin effector polypeptide according to claim 1, wherein the amino acid sequence has at least 95% sequence identity to amino acids 1 to 251 of SEQ ID NO: 1.

3. The polypeptide of claim 1, where the polypeptide comprises an amino acid sequence having at least 98% sequence identity to SEQ ID NO: 13.

4. A Shiga toxin effector polypeptide comprising an amino acid sequence having at least 98% sequence identity to SEQ ID NO: 13.

5. A cell-targeting molecule comprising i) a binding region capable of specifically binding an extracellular target biomolecule physically coupled to the cellular surface of a cell, and ii) the Shiga toxin effector polypeptide of claim 1.

6. The cell-targeting molecule of claim 5, wherein the binding region is fused to the carboxy terminus of the Shiga toxin effector polypeptide to form a single, continuous polypeptide.

7. The cell-targeting molecule of claim 5, wherein the binding region comprises an immunoglobulin-type binding region.

8. The cell-targeting molecule of claim 7, wherein the immunoglobulin-type binding region comprises a polypeptide selected from: single-domain antibody fragment, single-chain variable fragment, antibody variable fragment, complementary determining region 3 fragment, constrained FR3-CDR3-FR4 polypeptide, Fd fragment, antigen-binding fragment, fibronectin-derived 10th fibronectin type III domain, tenascin type III domain, ankyrin repeat motif domain, low-density-lipoprotein-receptor-derived A-domain, lipocalin, Kunitz domain, Protein-A-derived Z domain, gamma-B crystallin-derived domain, ubiquitin-derived domain, Sac7d-derived polypeptide, Fyn-derived SH2 domain, miniprotein, C-type lectin-like domain scaffold, a heavy-chain antibody domain derived from a camelid VHH fragment, heavy-chain antibody domain derived from cartilaginous fish, immunoglobulin new antigen receptor (IgNAR), VNAR fragment, multimerizing scFv fragment, bivalent minibody, bispecific tandem scFv, bispecific tandem VHH, and bispecific minibody.

9. The cell-targeting molecule of claim 5, which comprises the linker peptide shown in any one of SEQ ID NO: 540-543, 544-550, and 553-559.

10. The cell-targeting molecule of claim 5, which comprises the linker peptide shown in any one of SEQ ID NO: 540-543 and 553-557.

11. A pharmaceutical composition comprising the cell-targeting molecule of claim 5 and a pharmaceutically acceptable excipient or carrier.

12. A polynucleotide capable of encoding the cell-targeting molecule of claim 5.

13. An expression vector comprising the polynucleotide of claim 12.

14. A host cell comprising the polynucleotide of claim 12.

* * * * *